(12) United States Patent
Bartz et al.

(10) Patent No.: US 9,029,341 B2
(45) Date of Patent: May 12, 2015

(54) RNA INTERFERENCE MEDIATED INHIBITION OF HEPATITIS B VIRUS (HBV) GENE EXPRESSION USING SHORT INTERFERING NUCLEIC ACID (SINA)

(75) Inventors: Steve Bartz, Seattle, WA (US); Duncan Brown, Berkeley, CA (US); Michael Robinson, San Francisco, CA (US)

(73) Assignee: Sirna Therapeutics, Inc., Cambridge, MA (US)

( * ) Notice: Subject to any disclaimer, the term of this patent is extended or adjusted under 35 U.S.C. 154(b) by 0 days.

(21) Appl. No.: 13/817,152

(22) PCT Filed: Aug. 12, 2011

(86) PCT No.: PCT/US2011/047512
§ 371 (c)(1),
(2), (4) Date: Feb. 15, 2013

(87) PCT Pub. No.: WO2012/024170
PCT Pub. Date: Feb. 23, 2012

(65) Prior Publication Data
US 2013/0150433 A1 Jun. 13, 2013

Related U.S. Application Data

(60) Provisional application No. 61/374,555, filed on Aug. 17, 2010.

(51) Int. Cl.
*C12N 15/11* (2006.01)
*C12N 15/113* (2010.01)
*A61K 9/51* (2006.01)

(52) U.S. Cl.
CPC ........ *C12N 15/1131* (2013.01); *C12N 2310/14* (2013.01); *C12N 2310/315* (2013.01); *C12N 2320/32* (2013.01); *A61K 9/5123* (2013.01)

(58) Field of Classification Search
USPC ....................................................... 514/44 A
See application file for complete search history.

(56) References Cited

U.S. PATENT DOCUMENTS

| | | |
|---|---|---|
| 8,618,277 B2 | 12/2013 | Beigelman et al. |
| 8,648,185 B2 | 2/2014 | McSwigen et al. |
| 8,809,293 B2 | 8/2014 | Chin et al. |
| 2003/0206887 A1 | 11/2003 | Morrissey et al. |
| 2010/0145038 A1 | 6/2010 | McSwiggen et al. |

FOREIGN PATENT DOCUMENTS

| | | |
|---|---|---|
| CN | 101603042 A | 12/2009 |
| WO | WO-98/28004 A1 | 7/1998 |
| WO | WO-2005/014806 | 2/2005 |
| WO | WO-2006/069064 | 6/2006 |

OTHER PUBLICATIONS

Chen at al., RNAI for treating Hepatitis B Viral Infection, Pharmaceutical Research, 2008 vol. 25, No. I, pp. 72-86.

*Primary Examiner* — Brian Whiteman
(74) *Attorney, Agent, or Firm* — McCarter & English, LLP; Maria Laccotripe Zacharakis; Deborah L. Nagle

(57) ABSTRACT

The present invention relates to compounds, compositions, and methods for the study, diagnosis, and treatment of traits, diseases and conditions that respond to the modulation of HBV gene expression and/or activity, and/or modulate a HBV gene expression pathway. Specifically, the invention relates to double-stranded nucleic acid molecules including small nucleic acid molecules, such as short interfering nucleic acid (siNA), short interfering RNA (siRNA), double-stranded RNA (dsRNA), micro-RNA (miRNA), and short hairpin RNA (shRNA) molecules that are capable of mediating or that mediate RNA interference (RNAi) against HBV gene expression.

15 Claims, 12 Drawing Sheets

B ——————— $N_{X3}$ ——————— $[N]_{X2}$  B  -3'

B $(N)_{X1}$ ——————— $N_{X4}$ ——————— $[N]_{X5}$ -5'

| $N_{X3}$ Y/R | $N_{X4}$ Y/R | $[N]_{X5}$ Y/R |
|---|---|---|
| (5+) 2'-F/OH Optional PS | (5+) 2'-F/OH Optional PS | 2'-OH/OH or 2'-OMe/OH or 2'-F/OH + Optional PS |
| (5+) 2'-OMe/OH Optional PS | (5+) 2'-OMe/OH Optional PS | |
| (5+) 2'-F/H Optional PS | (5+) 2'-F/OMe Optional PS | |
| (5+) 2'-OMe/F Optional PS | (5+) 2'-F/OMe Optional PS | |

$(N)_{X1}$ = 2'-OMe/F/H/LNA + Optional PS
$(N)_{X2}$ = 2'-OM/F/H/LNAe + Optional PS

FIG.3 n = 0, 1, 2, 3, 4

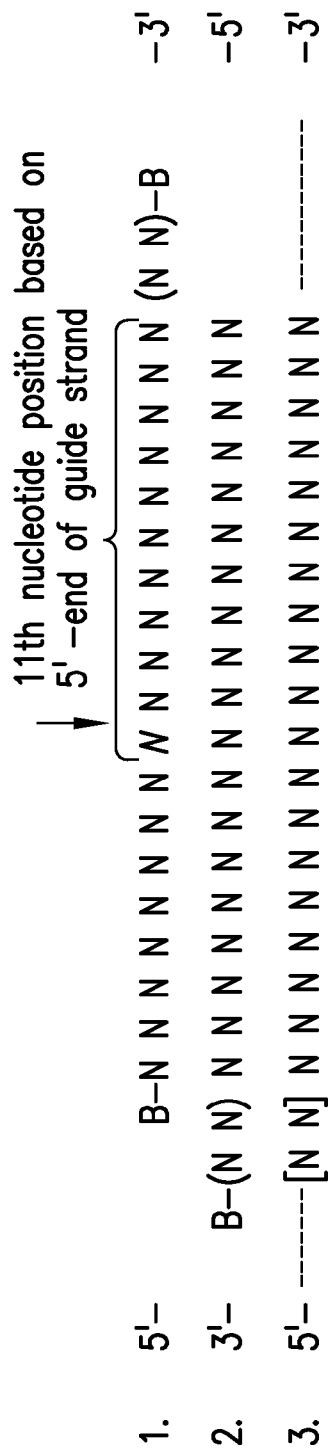

1. = sense strand (passenger strand)
2. = antisense strand (guide strand)
3. = target polynucleotide sequence The guide strand is complementary to the target sequence and the passenger strand is complementary to the guide strand. Overhang nucleotides (NN) in the guide strand can be complementary to nucleotides [NN] in target sequence. Overhang nucleotides (NN) in the passenger strand can comprise nucleotides [NN] in target sequence. Position $N$ of the passenger strand can comprise a ribonucleotide. For the representative 19 base pair 21 mer duplex shown, position $N$ is 9 nucleotides in from the 3' end of the passenger strand. However, in duplexes of differing length, the position $N$ is determined based on the 5'-end of the guide strand by counting 11 nucleotide positions in from the 5'-terminus of the guide strand and picking the corresponding base paired nucleotide in the passenger strand. Generally, cleavage by Ago2 takes place between positions 10 and 11 as indicated by the arrow.
Representative 2 nucleotide overhangs are shown, but can vary for example from 0 to about 4 nucleotides.
B = terminal cap which can be present or absent
This generalized motif can be applied to all Stab chemistries herein (see Table 7).

FIG.4C

RNA INTERFERENCE MEDIATED INHIBITION OF HEPATITIS B VIRUS (HBV) GENE EXPRESSION USING SHORT INTERFERING NUCLEIC ACID (SINA)

CROSS-REFERENCE TO RELATED APPLICATIONS

This application is a §371 National Stage Application of PCT/US2011/047512, international filing date of Aug. 12, 2011, which claims the benefit of U.S. Provisional Application No. 61/374,555 filed Aug. 17, 2010. The above listed application is hereby incorporated by reference herein in its entirety, including the drawings.

SEQUENCE LISTING

The sequence listing submitted via EFS, in compliance with 37 CFR §1.52(e)(5), is incorporated herein by reference. The sequence listing text file submitted via EFS contains the file SIRIFD00001USPCT-SEQTXT-15FEB2013", creation date of Feb. 15, 2013 and a size of 448 KB. This sequence listing submitted via EFS-Web is part of the specification and is herein incorporated by reference in its entirety.

BACKGROUND OF THE INVENTION

Hepatitis B is an infectious disease of the liver caused by the Hepatitis B virus (HBV). The illness can be acute causing liver inflammation, vomiting, jaundice and in some rare instances of severe fulminant disease, death. The majority of infections result in chronic illness that can be either asymptomatic or resulting in chronic liver inflammation leading to cirrhosis of the liver and an increased incidence in the development of hepatocellular carcinoma (HCC).

HBV infection is a global problem with approximately >350 million people world wide chronically infected and 600,000 die each year from HBV-related liver disease or HCC. The disease has caused epidemics in Asia and Africa and is endemic in China. Transmission of HBV is via infectious blood or body fluids. There are currently vaccines for the prevention of HBV infection. However, the vaccine is prophylatic and cannot be used to treat already infected patients.

There are several approved chemotherapeutic treatments for chronic hepatitis B (lamivudine, adefovir, entacavir and telbivudine) that prevent replication of HBV by blocking the action of the HBV polymerase. None of the treatments result in complete clearance of the virus and these treatment result in drug-resistant HBV variants developing after prolonged treatment. Hepatitis B can also be treated with pegylated Interferon-alpha2a but this treatment is associated with severe side effects and is not effective in all patients.

HBV is a member of the Hepadanvirus family and is divided into 4 major serotoyes (adr, adw, ayr, ayw) based on antigenic epitopes. The virus is also classed into eight genoypes (A-H based on genomic sequence. Genotype A is common in the Americas, Africa, India and Western Europe. Genotype B and C are found in Asia and the US. Genotype D is most common in Southern Europe and India. Genotype E is found in Western and Southern Africa. Genotype F and H are commonly found in Central and Southern America. Genotype G is commonly found in Europe and the U.S.

HBV genome consists of a circular strand of DNA that is partially double stranded. The genome is ~3.3 Kb in length. It encodes 4 known genes (C, X, P and S). HBV is one of the few DNA viruses that utilize reverse transcriptase in the replication process. HBV replication involves multiples stages including entry, uncoating and transport of the virus genome to the nucleus. Initially, replication of the HBV genome involves the generation of an RNA intermediate that is then reverse transcribed to produce the DNA viral genome.

Since current therapies are limited due to their ineffectiveness, serious side effects or due to the generation of drug resistant variants, there is a clinical need for the development of new therapies to treat HBV infection.

Alteration of viral gene expression, specifically HBV gene expression, through RNA interference (hereinafter "RNAi") is one approach for meeting this need. RNAi is induced by short single-stranded RNA ("ssRNA") or double-stranded RNA ("dsRNA") molecules. The short dsRNA molecules, called "short interfering nucleic acids ("siNA")" or "short interfering RNA" or "siRNA" or "RNAi inhibitors" silence the expression of messenger RNAs ("mRNAs") that share sequence homology to the siNA. This can occur via cleavage of the mRNA mediated by an endonuclease complex containing a siNA, commonly referred to as an RNA-induced silencing complex (RISC). Cleavage of the target RNA typically takes place in the middle of the region complementary to the guide sequence of the siNA duplex (Elbashir et al., 2001, *Genes Dev.*, 15:188). In addition, RNA interference can also involve small RNA (e.g., micro-RNA or miRNA) mediated gene silencing, presumably through cellular mechanisms that either inhibit translation or that regulate chromatin structure and thereby prevent transcription of target gene sequences (see for example Allshire, 2002, *Science*, 297:1818-1819; Volpe et al., 2002, *Science*, 297:1833-1837; Jenuwein, 2002, *Science*, 297:2215-2218; and Hall et al., 2002, *Science*, 297: 2232-2237).

Several studies have attempted to use RNAi for the treatment of HBV and this approach has been comprehensively reviewed in *RNAi for treating Hepatitis B Viral Infection*, Chen, Y. et al., Pharmaceutical Research, 2008 Vol. 25, No. 1, pgs 72-86. Yet, as noted in the above reference transfection of a single siRNA often fails to provide adequate gene silencing, Id. Thus, despite significant advances in the field of RNAi, there remains a need for agents that can effectively inhibit HBV gene expression and that can treat disease associated with HBV expression such as liver disease and cancer.

SUMMARY OF THE INVENTION

The invention provides a solution to the problem of treating diseases that respond to the modulation of the HBV gene expression using novel short interfering nucleic acid (siNA) molecules to modulate HBV expression.

The present invention provides compounds, compositions, and methods useful for modulating the expression of HBV genes and for treating hepatitis B and such conditions that result from hepatitis B infection by RNA interference (RNAi) using small nucleic acid molecules.

In particular, the instant invention features small nucleic acid molecules, i.e., short interfering nucleic acid (siNA) molecules including, but not limited to, short interfering RNA (siRNA), double-stranded RNA (dsRNA), micro-RNA (miRNA), short hairpin RNA (shRNA) and circular RNA molecules and methods used to modulate the expression of HBV genes and/or other genes involved in pathways of HBV gene expression and/or activity. The inventors have found that selection of targets sites from the conserved regions of all known full HBV genomes resulted in sequences with high potency and efficacy.

In one aspect, the invention provides double-stranded short interfering nucleic acid (siNA) molecules that inhibit the expression of a HBV gene in a cell or mammal, wherein the double-stranded siNAs comprise a sense and an antisense stand. The antisense strand comprises a sequence that is complementary to at least a part of an RNA associated with the expression of the HBV gene. The sense strand comprises a sequence that is complementary to the antisense strand. In various embodiments, at least one strand comprises at least a 15 nucleotide sequence selected from the group of sequences consisting of SEQ ID NOS:1-502. In certain embodiments, the antisense strand comprises at least 15 nucleotides having sequence complementarity to a target sequence set forth in Table 1a. In other and/or in the same embodiments, the antisense strand comprises at least a 15 nucleotide sequence of one of the antisense sequences set forth in Table 1b. In some embodiments, the sense strand comprises at least a 15 nucleotide sequence of a sense strand sequence as set forth in Table 1b.

In certain embodiments of this aspect of the invention, double-stranded short interfering nucleic acid (siNA) molecules are provided wherein the antisense stand comprises a modified sequence as set forth in Table 1c that has sequence complementarity to a target sequence of the invention. In some embodiments, the sense strand also comprises a modified sequence as set forth in Table 1c.

In certain embodiments, the present invention provides a double-stranded short interfering nucleic acid (siNA) molecule that modulates the expression of HBV, wherein the siNA comprises a sense strand and an antisense strand; each strand is independently 15 to 30 nucleotides in length; and the antisense strand comprises at least 15 nucleotides having sequence complementary to any of:

(SEQ ID NO: 1)
5'-UCGUGGUGGACUUCUCUCA-3';

(SEQ ID NO: 2)
5'-GUGGUGGACUUCUCUCAAU-3';

(SEQ ID NO: 3)
5'-GCCGAUCCAUACUGCGGAA-3';
or (SEQ ID NO: 4)
5'-CCGAUCCAUACUGCGGAAC-3'.

In some embodiments of the invention, the antisense strand of a siNA molecule comprises at least a 15 nucleotide sequence of:

(SEQ ID NO: 452)
5'-UGAGAGAAGUCCACCACGA-3';

(SEQ ID NO: 453)
5'-AUUGAGAGAAGUCCACCAC-3';

(SEQ ID NO: 454)
5'-UUCCGCAGUAUGGAUCGGC-3';
or (SEQ ID NO: 455)
5'-GUUCCGCAGUAUGGAUCGG-3'.

In some embodiments, the sense strand of a siNA molecule of the invention comprises at least a 15 nucleotide sequence of:

(SEQ ID NO: 1)
5'-UCGUGGUGGACUUCUCUCA-3';

(SEQ ID NO: 2)
5'-GUGGUGGACUUCUCUCAAU-3';

(SEQ ID NO: 3)
5'-GCCGAUCCAUACUGCGGAA-3';
or (SEQ ID NO: 4)
5'-CCGAUCCAUACUGCGGAAC-3'.

In some embodiments, a siNA molecule of the invention comprises any of:

(SEQ ID NO: 1)
5'-UCGUGGUGGACUUCUCUCA-3'
and (SEQ ID NO: 452)
5'-UGAGAGAAGUCCACCACGA-3';
or (SEQ ID NO: 2)
5'-GUGGUGGACUUCUCUCAAU-3';
and (SEQ ID NO: 453)
5'-AUUGAGAGAAGUCCACCAC-3';
or (SEQ ID NO: 3)
5'-GCCGAUCCAUACUGCGGAA-3'
and (SEQ ID NO: 454)
5'-UUCCGCAGUAUGGAUCGGC-3';
or (SEQ ID NO: 4)
5'-CCGAUCCAUACUGCGGAAC-3 ';
and (SEQ ID NO: 455)
5'-GUUCCGCAGUAUGGAUCGG-3'.

In some embodiments, the invention features a double-stranded short interfering nucleic acid (siNA) molecule comprising any of duplex R-008380648-000E, R-008380783-000R, R-008380665-000N, R-008380645-000D, R-008380408-000R, R-008380633-000U, R-008380767-000R, R-008380730-000C, R-008380777-000H, R-008380740-000V, R-008380558-000M, R-008380406-000Y, R-008380764-000P, R-008380772-000P, R-008380389-000D, R-008380362-000H, R-008380363-000S, R-008380340-000F, R-008380689-000H, R-008380756-000P, R-008380736-000E, R-008380757-000Y, R-008380753-000N, R-008380737-000N, R-008380734-000M, or R-008380791-000R In some embodiments, the invention features a composition comprising:
(a) a double-stranded short interfering nucleic acid (siNA) of the invention;
(b) a cationic lipid compound having any of compound numbers 1-46 or any combination thereof;
(c) cholesterol;
(d) DSPC; and
(e) PEG-DMG.

In some embodiments, a composition of the invention comprises any Cationic Lipid having any of compound numbers 1-46 in the following molar ratios:
Cationic Lipid/Cholesterol/PEG-DMG 56.6/38/5.4;
Cationic Lipid/Cholesterol/PEG-DMG 60/38/2;
Cationic Lipid/Cholesterol/PEG-DMG 67.3/29/3.7;
Cationic Lipid/Cholesterol/PEG-DMG 49.3/47/3.7;
Cationic Lipid/Cholesterol/PEG-DMG 50.3/44.3/5.4;

Cationic Lipid/Cholesterol/PEG-C-DMA/DSPC 40/48/2/10;

Cationic Lipid/Cholesterol/PEG-DMG/DSPC 40/48/2/10; and

Cationic Lipid/Cholesterol/PEG-DMG/DSPC 58/30/2/10.

In some embodiments, a composition of the invention comprises (13Z,16Z)—N,N-dimethyl-3-nonyldocosa-13,16-dien-1-amine, cholesterol, DSPC, and PEG-DMG, having a molar ratio of about 50:30:10:2 respectively.

In some embodiments, a composition of the invention further comprises a cryoprotectant. In some embodiments, the cryoprotectant is Sucrose, Trehalose, Raffinose, Stachyose, Verbascose, Mannitol, Glucose, Lactose, Maltose, Maltotriose-heptaose, Dextran, Hydroxyethyl Starch, Insulin, Sorbitol, Glycerol, Arginine, Histidine, Lysine, Proline, Dimethylsulfoxide or any combination thereof. In some embodiments, the cryoprotectant is Sucrose. In some embodiments, the cryoprotectant is Trehalose. In some embodiments, the cryoprotectant is a combination of Sucrose and Trehalose.

In some embodiments of the invention, all of the nucleotides of siNAs of the invention are unmodified. In other embodiments, one or more (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30) of the nucleotide positions independently in either one or both strands of an siNA molecule are modified. Modifications include nucleic acid sugar modifications, base modifications, backbone (internucleotide linkage) modifications, non-nucleotide modifications, and/or any combination thereof. In certain instances, purine and pyrimidine nucleotides are differentially modified. For example, purine and pyrimidine nucleotides can be differentially modified at the 2'-sugar position (i.e., at least one purine has a different modification from at least one pyrimidine in the same or different strand at the 2'-sugar position). In certain instances the purines are unmodified in one or both strands, while the pyrimidines in one or both strands are modified. In certain other instances, the pyrimidines are unmodified in one or both strands, while the purines in one or both strands are modified. In some instances, at least one modified nucleotide is a 2'-deoxy-2'-fluoro nucleotide, a 2'-deoxy nucleotide, or a 2'-O-alkyl nucleotide. In some instances, at least 5 or more of the pyrimidine nucleotides in one or both stands are either all 2'-deoxy-2'-fluoro or all 2'-O-methylpyrimidine nucleotides. In some instances, at least 5 or more of the purine nucleotides in one or both stands are either all 2'-deoxy-2'-fluoro or all 2'-O-methyl purine nucleotides. In certain instances, wherein the siNA molecules comprise one or more modifications as described herein, the nucleotides at positions 1, 2, and 3 at the 5' end of the guide (antisense) strand are unmodified.

In certain embodiments, the siNA molecules of the invention have 3' overhangs of one, two, three, or four nucleotide(s) on one or both of the strands. In other embodiments, the siNA molecules lack overhangs (i.e., have blunt ends). Preferably, the siNA molecule has 3' overhangs of two nucleotides on both the sense and antisense strands. The overhangs can be modified or unmodified. Examples of modified nucleotides in the overhangs include, but are not limited to, 2'-O-alkyl nucleotides, 2'-deoxy-2'-fluoro nucleotides, locked nucleic acid (LNA) nucleotides, or 2'-deoxy nucleotides. The overhang nucleotides in the antisense strand can comprise nucleotides that are complementary to nucleotides in the HBV target sequence. Likewise, the overhangs in the sense stand can comprise nucleotides that are in the HBV target sequence. In certain instances, the siNA molecules of the invention have two 3' overhang nucleotides on the antisense stand that are 2'-O-alkyl (e.g., 2'-O-methyl) nucleotides and two 3' overhang nucleotides on the sense stand that are 2'-deoxy nucleotides. In other instances, the siNA molecules of the invention have two 3' overhang nucleotides that are 2'-O-alkyl (e.g., 2'-O-methyl) nucleotides on both the antisense stand and on the sense stand. In certain embodiments, the 2'-O-alkyl nucleotides are 2'-O-methyl uridine nucleotides. In certain instances, the overhangs also comprise one or more phosphorothioate linkages between nucleotides of the overhang.

In some embodiments, the siNA molecules of the invention have caps (also referred to herein as "terminal caps." The cap can be present at the 5'-terminus (5'-cap) or at the 3'-terminus (3'-cap) or can be present on both termini, such as at the 5' and 3' termini of the sense strand of the siNA.

In some embodiments, the siNA molecules of the invention are phosphorylated at the 5' end of the antisense strand. The phosphate group can be a phosphate, a diphosphate or a triphosphate.

The siNA molecules of the invention when double stranded can be symmetric or asymmetric. Each strand of these double stranded siNAs independently can range in nucleotide length between 3 and 30 nucleotides. Generally, each strand of the siNA molecules of the invention is about 15 to 30 (i.e., about 19, 20, 21, 22, 23 or 24) nucleotides in length.

The siNA molecules of the invention, which are double stranded or have a duplex structure, independently comprise about 3 to about 30 (e.g., about 3, 4, 5, 6, 7, 8, 9, 10, 11, 12, 13, 14, 15, 16, 17, 18, 19, 20, 21, 22, 23, 24, 25, 26, 27, 28, 29, or 30) base pairs. Generally, the duplex structure of siNAs of the invention is between 15 and 30, more generally between 18 and 25, yet more generally between 19 and 24, and most generally between 19 and 21 base pairs in length.

In certain embodiments, double-stranded short interfering nucleic acid (siNA) molecules are provided, wherein the molecule has a sense strand and an antisense strand and comprises formula (A):

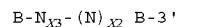
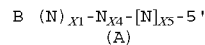

wherein, the upper strand is the sense strand and the lower strand is the antisense strand of the double-stranded nucleic acid molecule; wherein the antisense strand comprises at least a 15 nucleotide sequence of SEQ ID NO: 452, SEQ ID NO: 453, SEQ ID NO: 454, or SEQ ID NO: 455, and the sense strand comprises a sequence having complementarity to the antisense strand;

each N is independently a nucleotide which is unmodified or chemically modified or a non-nucleotide;

each B is a terminal cap that is present or absent;

(N) represents overhanging nucleotides, each of which is independently unmodified or chemically modified;

[N] represents nucleotides that are ribonucleotides;

X1 and X2 are independently integers from 0 to 4;

X3 is an integer from 15 to 30;

X4 is an integer from 9 to 30; and

X5 is an integer from 0 to 6, provided that the sum of X4 and X5 is 15-30.

In one embodiment, the invention features a double-stranded short interfering nucleic acid (siNA) of formula (A); wherein (a) one or more pyrimidine nucleotides in $N_{X4}$ positions are independently 2'-deoxy-2'-fluoro nucleotides, 2'-O-alkyl nucleotides, 2'-deoxy nucleotides, ribonucleotides, or any combination thereof;

(b) one or more purine nucleotides in $N_{X4}$ positions are independently 2'-deoxy-2'-fluoro nucleotides, 2'-O- alkyl nucleotides, 2'-deoxy nucleotides, ribonucleotides, or any combination thereof;

(c) one or more pyrimidine nucleotides in $N_{X3}$ positions are independently 2'-deoxy-2'-fluoro nucleotides, 2'-O-alkyl nucleotides, 2'-deoxy nucleotides, ribonucleotides, or any combination thereof; and (d) one or more purine nucleotides in $N_{X3}$ positions are independently 2'-deoxy-2'-fluoro nucleotides, 2'-O-alkyl nucleotides, 2'-deoxy nucleotides, ribonucleotides, The present invention further provides compositions comprising the double-stranded nucleic acid molecules described herein with optionally a pharmaceutically acceptable carrier or diluent.

The administration of the composition can be carried out by known methods, wherein the nucleic acid is introduced into a desired target cell in vitro or in vivo.

Commonly used techniques for introduction of the nucleic acid molecules of the invention into cells, tissues, and organisms include the use of various carrier systems, reagents and vectors. Non-limiting examples of such carrier systems suitable for use in the present invention include conjugates, nucleic-acid-lipid particles, lipid nanoparticles (LNP), liposomes, lipoplexes, micelles, virosomes, virus like particles (VLP), nucleic acid complexes, and mixtures thereof.

The compositions of the invention can be in the form of an aerosol, dispersion, solution (e.g., an injectable solution), a cream, ointment, tablet, powder, suspension or the like. These compositions may be administered in any suitable way, e.g. orally, sublingually, buccally, parenterally, nasally, or topically. In some embodiments, the compositions are aerosolized and delivered via inhalation.

The molecules and compositions of the present invention have utility over a broad range of therapeutic applications. Accordingly another aspect of this invention relates to the use of the compounds and compositions of the invention in treating a subject. The invention thus provides a method for treating a subject, such as a human, suffering from a condition which is mediated by the action of HBV, wherein the method comprises administering to the subject an effective amount of a double-stranded short interfering nucleic acid (siNA) molecule of the invention. Thus, the siNA molecules of the invention treat the hepatitis B infection and/or conditions resulting therefrom. In some embodiments, the condition is liver disease. In other embodiments, the condition is cancer.

These and other aspects of the invention will be apparent upon reference to the following detailed description and attached figures. Moreover, it is contemplated that any method or composition described herein can be implemented with respect to any other method or composition described herein and that different embodiments may be combined.

Additionally, patents, patent applications, and other documents are cited throughout the specification to describe and more specifically set forth various aspects of this invention. Each of these references cited herein is hereby incorporated by reference in its entirety, including the drawings.

BRIEF DESCRIPTION OF THE DRAWINGS

FIG. 3 shows non-limiting examples of certain combinations of modifications applied to the representative siNA duplex described in FIG. 2. The table shown below the representative structure provides specific combinations of $(N)_{X1}$, $(N)_{X2}$, $N_{X3}$, $N_{X4}$, and/or $[N]_{X5}$ nucleotide (and optional non-nucleotide) positions. For example, combinations of 5 or more (e.g., 5, 6, 7, 8, 9, or 10 or more) $N_{X3}$ and 5 or more (e.g., 5, 6, 7, 8, 9, or 10 or more) $N_{X4}$ pyrimidine "Y" and purine "R" nucleotides are specified, each of which can independently have specific $(N)_{X1}$, and/or $(N)_{X2}$, substitutions as shown in the figure, in addition to optional phosphorothioate substitutions. The 5'-terminal antisense strand [N] nucleotides are generally ribonucleotides, but can also be modified or unmodified depending on if they are purine "R" or pyrimidine "Y" nucleotides FIGS. 4A-C shows non-limiting examples of different siNA constructs of the invention. The criteria of the representative structures shown in FIGS. 2 and 3 can be applied to any of the structures shown in FIG. 4A-C.

Figure 4A:
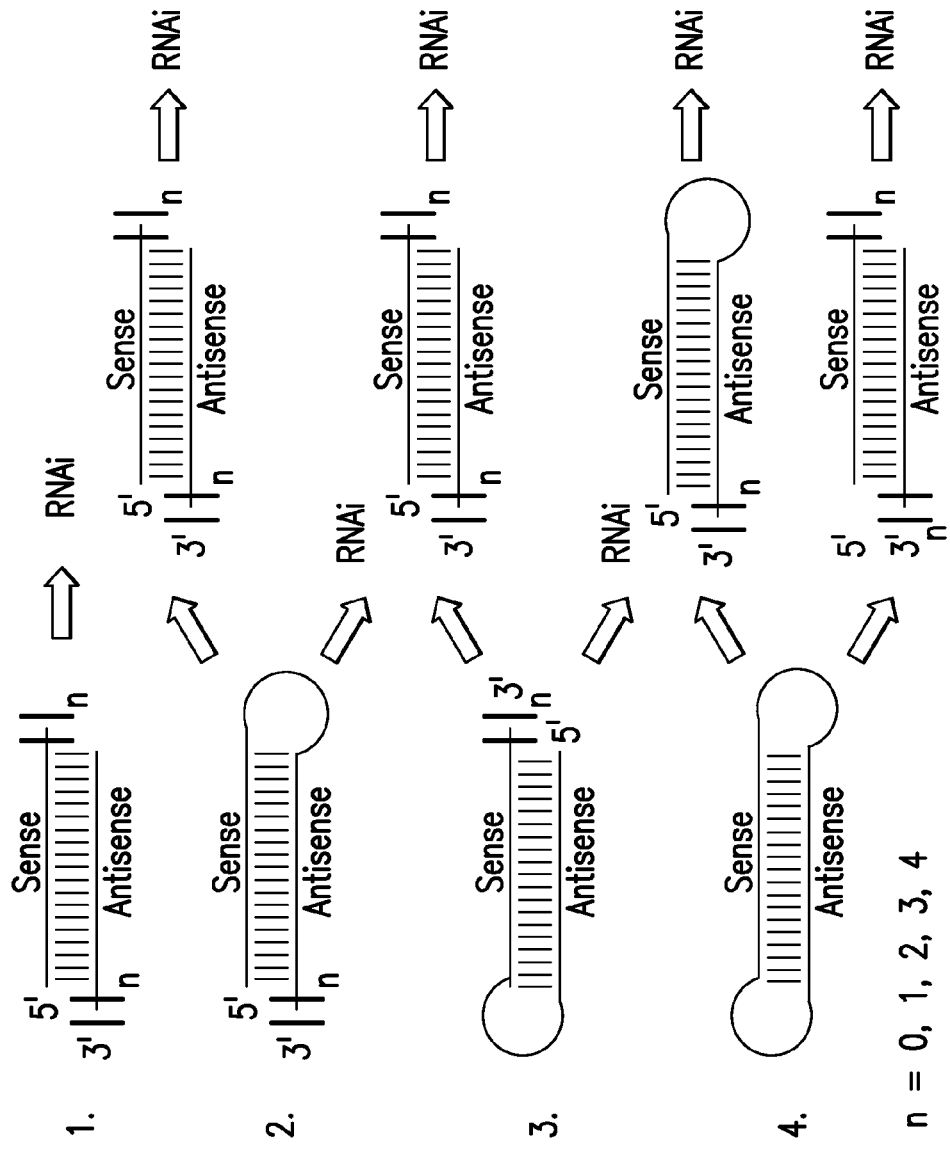

The examples shown in FIG. 4A (constructs 1, 2, and 3) have 19 representative base pairs; however, different embodiments of the invention include any number of base pairs described herein. Bracketed regions represent nucleotide overhangs, for example, comprising about 1, 2, 3, or 4 nucleotides in length, preferably about 2 nucleotides. Constructs 1 and 2 can be used independently for RNAi activity. Construct 2 can comprise a polynucleotide or non-nucleotide linker, which can optionally be designed as a biodegradable linker. In one embodiment, the loop structure shown in construct 2 can comprise a biodegradable linker that results in the formation of construct 1 in vivo and/or in vitro. In another example, construct 3 can be used to generate construct 2 under the same principle wherein a linker is used to generate the active siNA construct 2 in vivo and/or in vitro, which can optionally utilize another biodegradable linker to generate the active siNA construct 1 in vivo and/or in vitro. As such, the stability and/or activity of the siNA constructs can be modulated based on the design of the siNA construct for use in vivo or in vitro and/or in vitro.

Figure 4B:
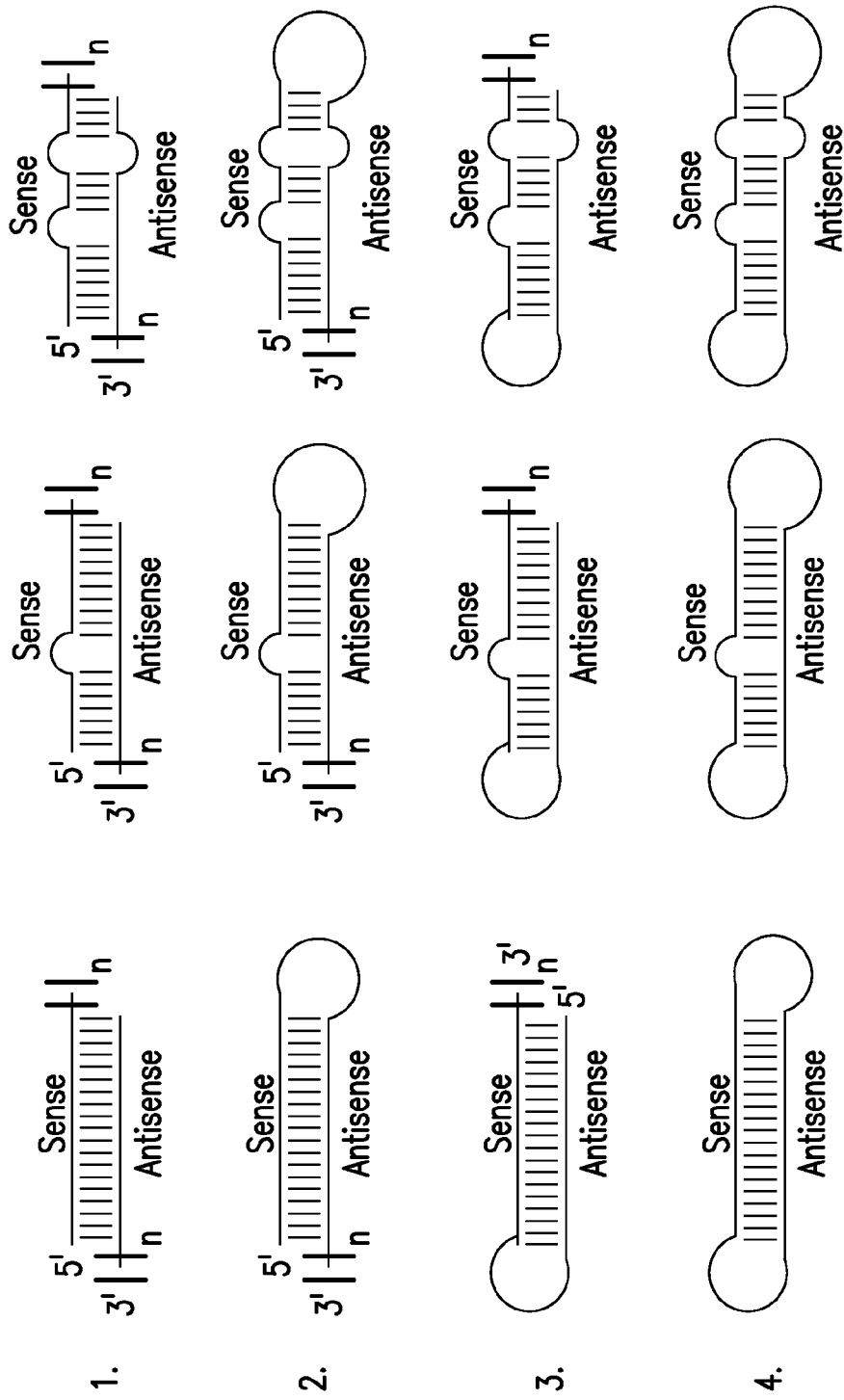

The examples shown in FIG. 4B represent different variations of double-stranded nucleic acid molecule of the invention, such as microRNA, that can include overhangs, bulges, loops, and stem-loops resulting from partial complementarity. Such motifs having bulges, loops, and stem-loops are generally characteristics of miRNA. The bulges, loops, and stem-loops can result from any degree of partial complementarity, such as mismatches or bulges of about 1, 2, 3, 4, 5, 6, 7, 8, 9, 10 or more nucleotides in one or both strands of the double-stranded nucleic acid molecule of the invention.

The example shown in FIG. 4C represents a model double-stranded nucleic acid molecule of the invention comprising a 19 base pair duplex of two 21 nucleotide sequences having dinucleotide 3'-overhangs. The top strand (1) represents the sense strand (passenger strand), the middle strand (2) represents the antisense (guide strand), and the lower strand (3) represents a target polynucleotide sequence. The dinucleotide overhangs (NN) can comprise a sequence derived from the target polynucleotide. For example, the 3'-(NN) sequence in the guide strand can be complementary to the 5'-[NN] sequence of the target polynucleotide. In addition, the 5'-(NN) sequence of the passenger strand can comprise the same sequence as the 5'-[NN] sequence of the target polynucleotide sequence. In other embodiments, the overhangs (NN) are not derived from the target polynucleotide sequence, for example where the 3'-(NN) sequence in the guide strand are not complementary to the 5'-[NN] sequence of the target polynucleotide and the 5'-(NN) sequence of the passenger strand can comprise different sequence from the 5'-[NN] sequence of the target polynucleotide sequence. In additional embodiments, any (NN) nucleotides are chemically modified, e.g., as 2'-O-methyl, 2'-deoxy-2'-fluoro, and/or other modifications herein. Furthermore, the passenger strand can comprise a ribonucleotide position N of the passenger strand. For the representative 19 base pair 21 mer duplex shown, position N can be 9 nucleotides in from the 3' end of the passenger strand. However, in duplexes of differing length, the position N is determined based on the 5'-end of the guide strand by counting 11 nucleotide positions in from the 5'-terminus of the guide strand and picking the corresponding base paired nucleotide in the passenger strand. Cleavage by Ago2 takes place between positions 10 and 11 as indicated by the arrow. In additional embodiments, there are two ribonucleotides, NN, at positions 10 and 11 based on the 5'-end of the guide strand by counting 10 and 11 nucleotide positions in from the 5'-terminus of the guide strand and picking the corresponding base paired nucleotides in the passenger strand.

Figure 5:
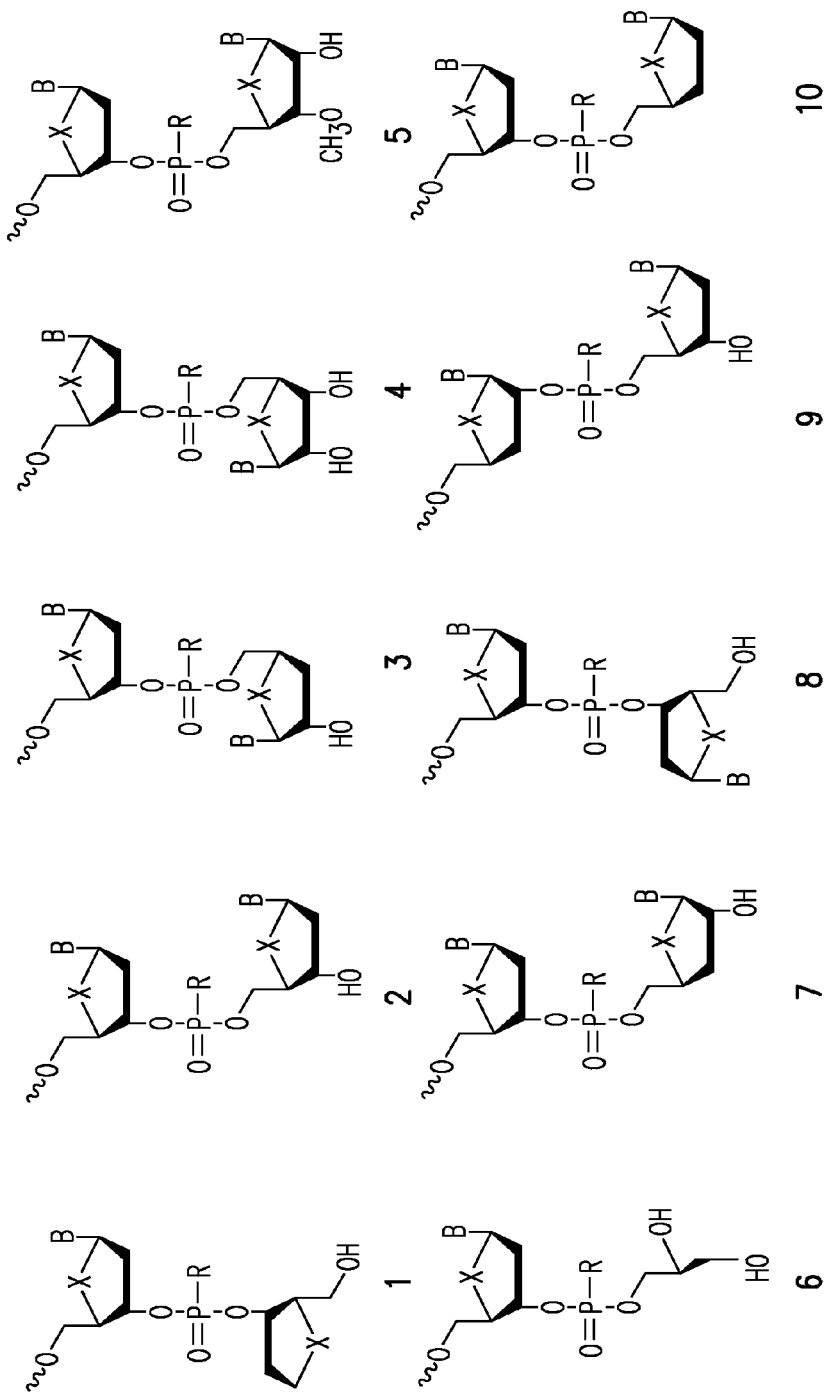

FIG. 5 shows non-limiting examples of different stabilization chemistries (1-10) that can be used, for example, to stabilize the 5' and/or 3'-ends of siNA sequences of the invention, including (1) [3-3']-inverted deoxyribose; (2) deoxyribonucleotide; (3) [5'-3']-3'-deoxyribonucleotide; (4) [5'-3']-ribonucleotide; (5) [5'-3']-3'-O-methyl ribonucleotide; (6) 3'-glyceryl; (7) [3'-5']-3'-deoxyribonucleotide; (8) [3'-3']-deoxyribonucleotide; (9) [5'-2']-deoxyribonucleotide; and (10) [5-3']-dideoxyribonucleotide (when X=O). In addition to modified and unmodified backbone chemistries indicated in the figure, these chemistries can be combined with different sugar and base nucleotide modifications as described herein.

Figure 6:
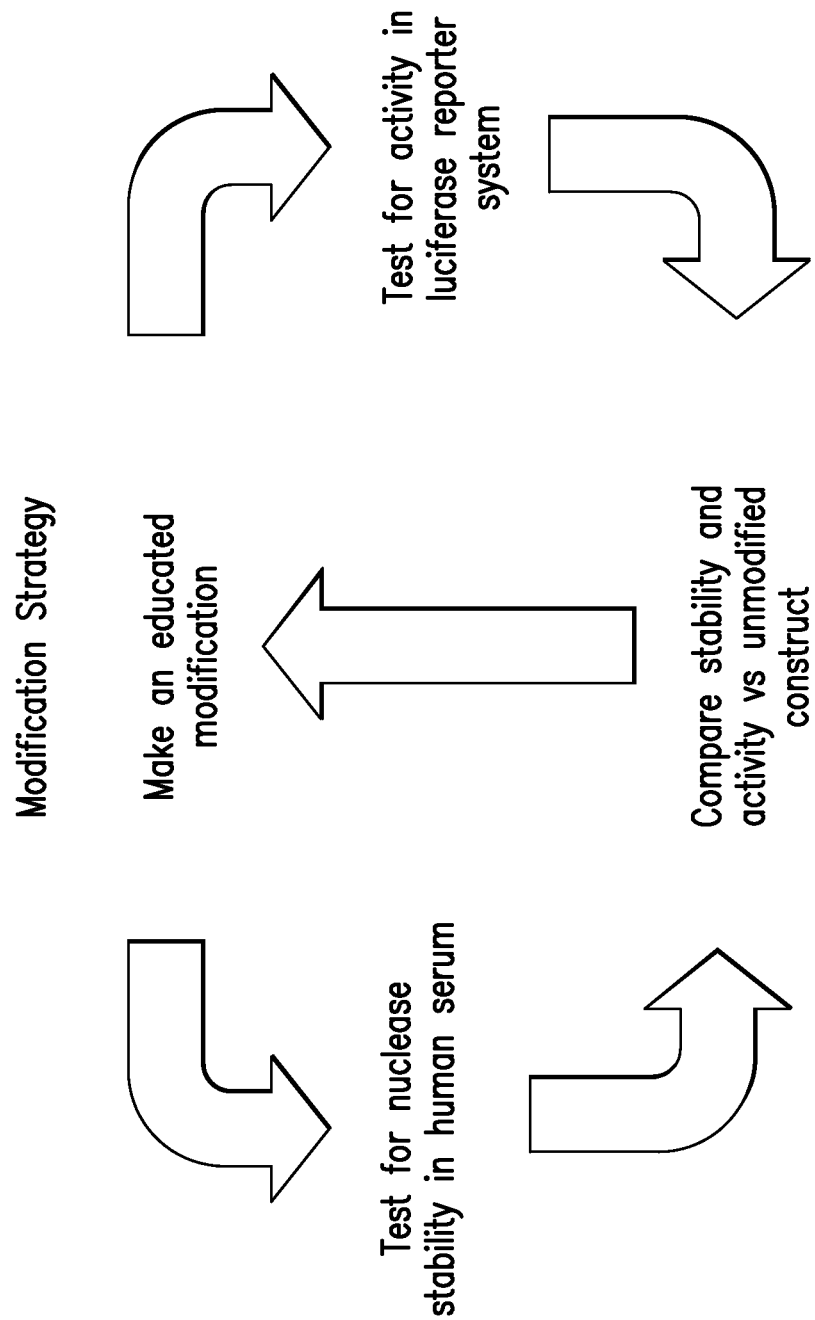

FIG. 6 shows a non-limiting example of a strategy used to identify chemically modified siNA constructs of the invention that are nuclease resistant while preserving the ability to mediate RNAi activity. Chemical modifications are introduced into the siNA construct based on educated design parameters (e.g. introducing 2'-modifications, base modifications, backbone modifications, terminal cap modifications etc). The modified construct is tested in an appropriate system (e.g., human serum for nuclease resistance, shown, or an animal model for PK/delivery parameters). In parallel, the siNA construct is tested for RNAi activity, for example in a cell culture system such as a luciferase reporter assay and/or against endogenous mRNA). Lead siNA constructs are then identified which possess a particular characteristic while maintaining RNAi activity, and can be further modified and assayed once again. This same approach can be used to identify siNA-conjugate molecules with improved pharmacokinetic profiles, delivery, and RNAi activity.

Figure 7:
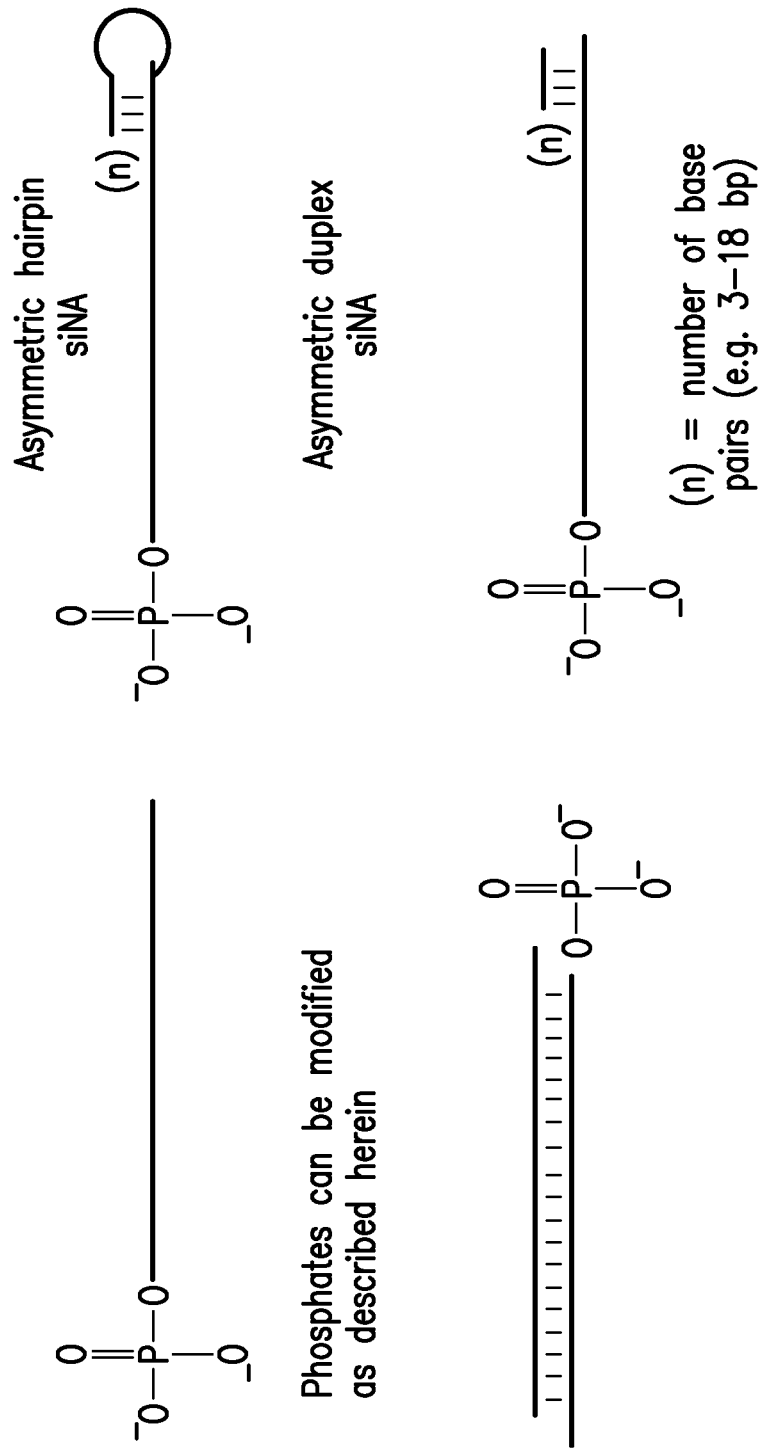

FIG. 7 shows non-limiting examples of phosphorylated siNA molecules of the invention, including linear and duplex constructs and asymmetric derivatives thereof.

Figure 8:
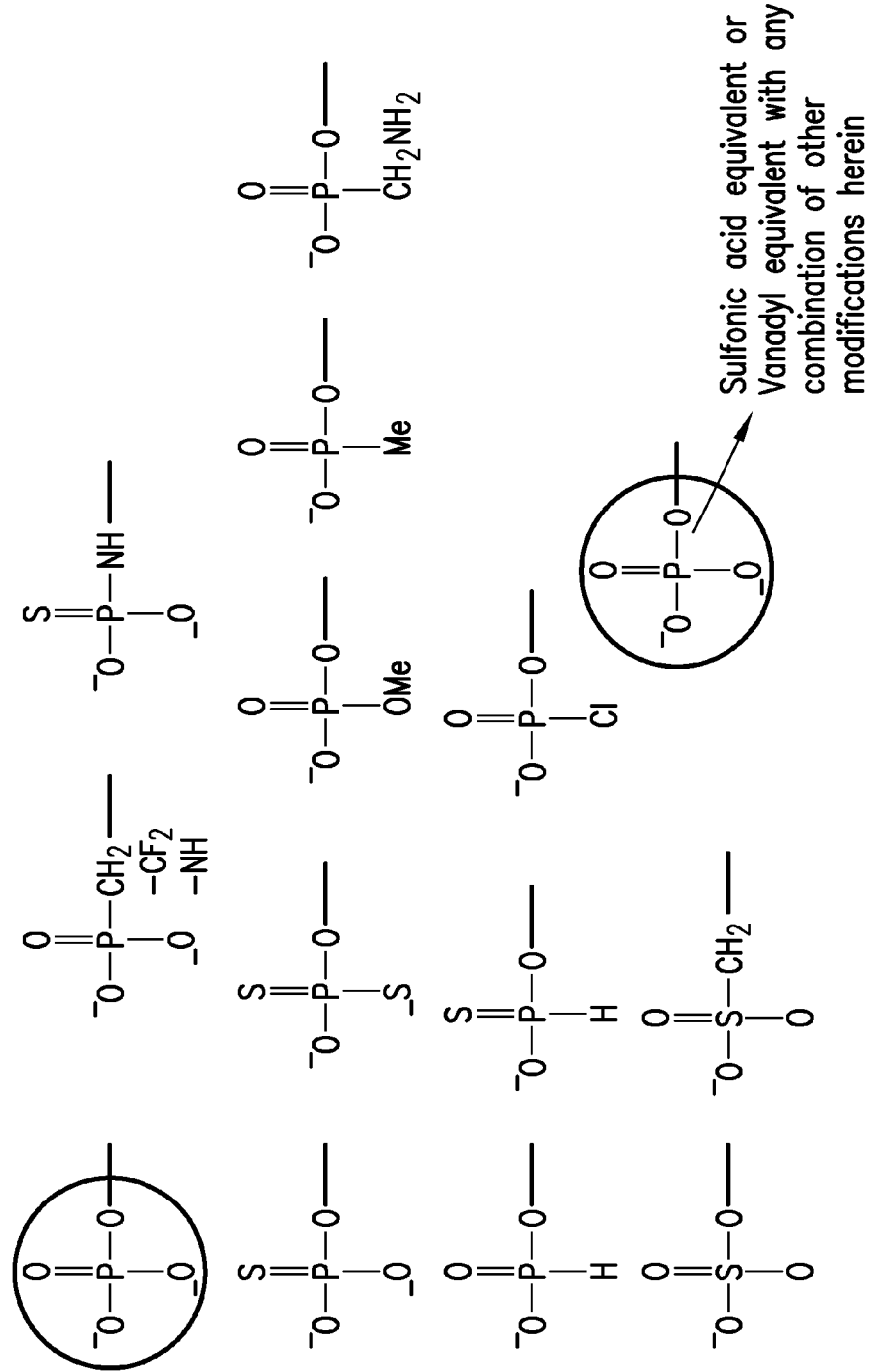

FIG. 8 shows non-limiting examples of chemically modified terminal phosphate groups of the invention.

Figure 9:
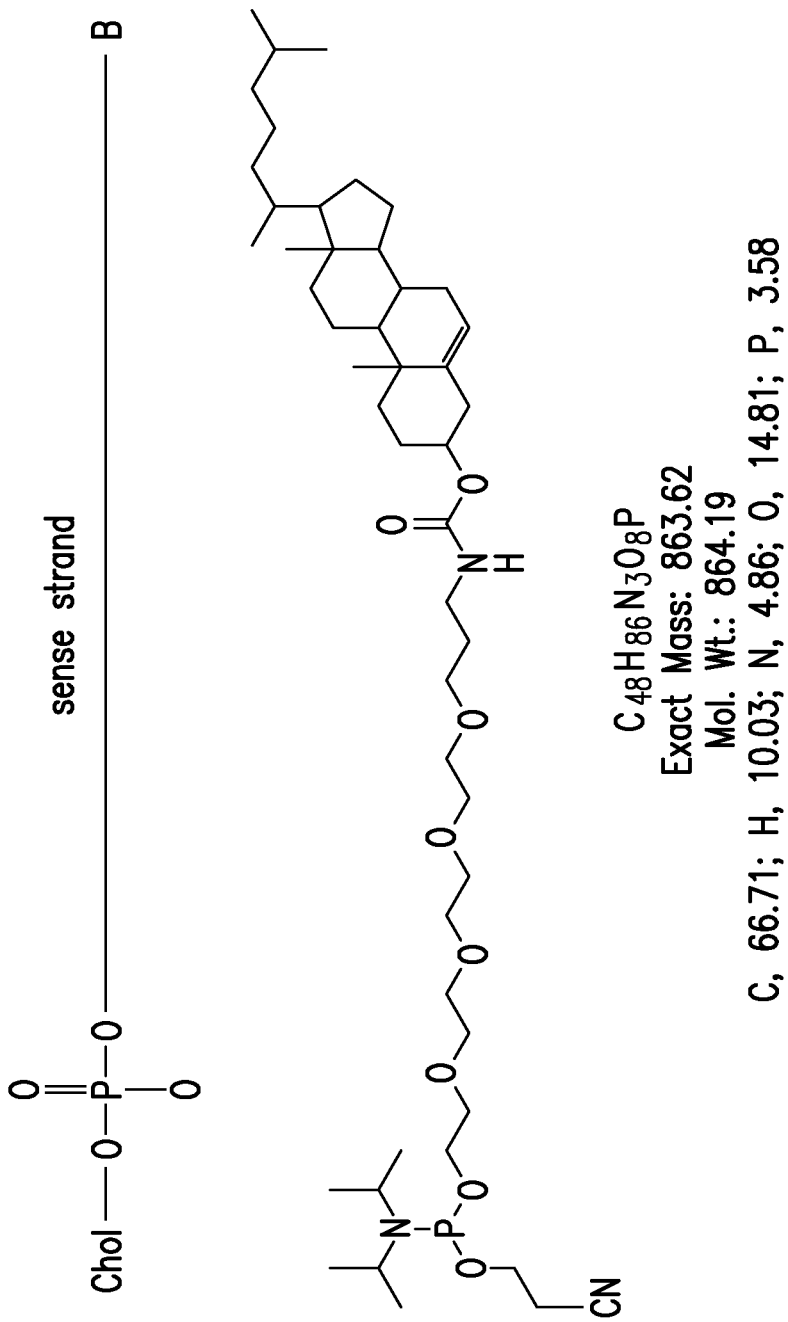

FIG. 9 shows a non-limiting example of a cholesterol linked phosphoramidite that can be used to synthesize cholesterol conjugated siNA molecules of the invention. An example is shown with the cholesterol moiety linked to the 5'-end of the sense strand of an siNA molecule.

Figure 10:
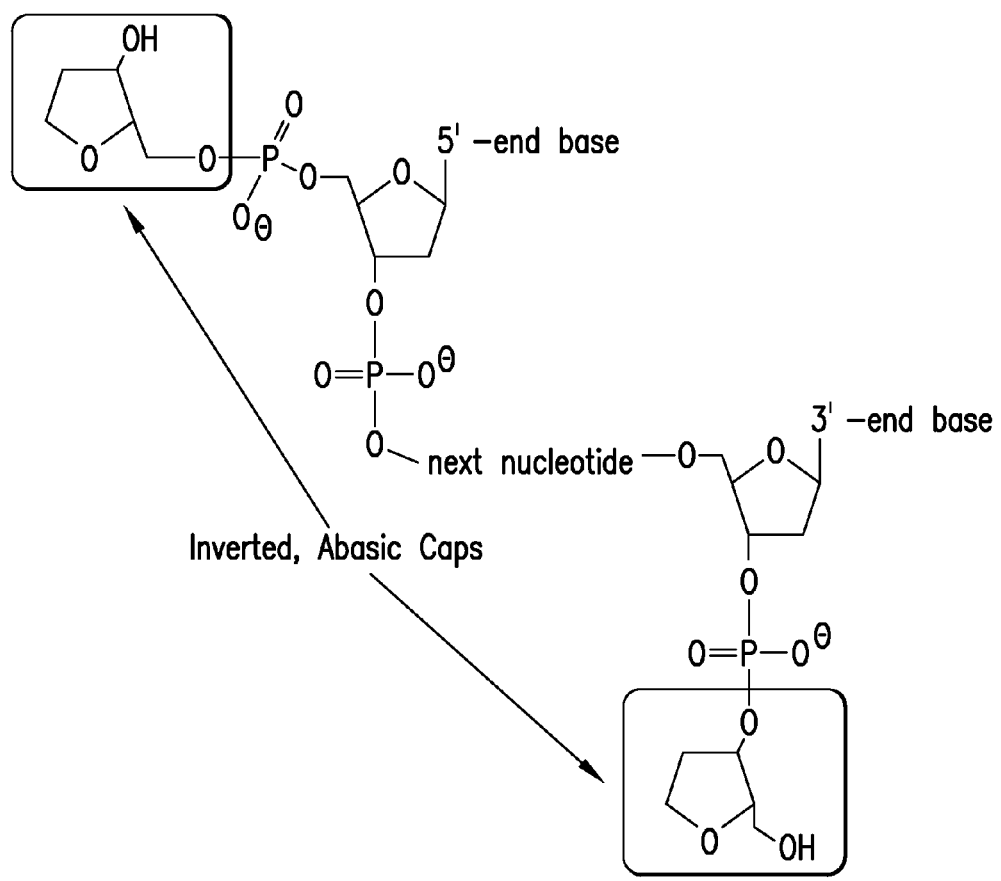

FIG. 10 depicts an embodiment of 5' and 3' inverted abasic cap linked to a nucleic acid strand.

DETAILED DESCRIPTION OF THE INVENTION

A. Terms and Definitions

The following terminology and definitions apply as used in the present application.

The term "abasic" as used herein refers to its meaning as is generally accepted in the art. The term generally refers to sugar moieties lacking a nucleobase or having a hydrogen atom (H) or other non-nucleobase chemical groups in place of a nucleobase at the 1' position of the sugar moiety, see for example Adamic et al., U.S. Pat. No. 5,998,203. In one embodiment, an abasic moiety of the invention is a ribose, deoxyribose, or dideoxyribose sugar.

The term "acyclic nucleotide" as used herein refers to its meaning as is generally accepted in the art. The term generally refers to any nucleotide having an acyclic ribose sugar, for example where any of the ribose carbon/carbon or carbon/oxygen bonds are independently or in combination absent from the nucleotide.

The term "alkyl" as used herein refers to its meaning as is generally accepted in the art. The term generally refers to a saturated or unsaturated hydrocarbons, including straight-chain, branched-chain, alkenyl, alkynyl groups and cyclic groups, but excludes aromatic groups. Notwithstanding the foregoing, alkyl also refers to non-aromatic heterocyclic groups. Preferably, the alkyl group has 1 to 12 carbons. More preferably, it is a lower alkyl of from 1 to 7 carbons, more preferably 1 to 4 carbons. The alkyl group can be substituted or unsubstituted. When substituted, the substituted group(s) is preferably, hydroxyl, halogen, cyano, C1-C4 alkoxy, =O, =S, $NO_2$, SH, $NH_2$, or $NR_1R_2$, where $R_1$ and $R_2$ independently are H or C1-C4 alkyl.

The phrase "agents that interfere with cell cycle checkpoints" refers to compounds that inhibit protein kinases that transduce cell cycle checkpoint signals, thereby sensitizing the cancer cell to DNA damaging agents.

The phrase "agents that interfere with receptor tyrosine kinases (RTKs)" refers to compounds that inhibit RTKs and therefore inhibit mechanisms involved in oncogenesis and tumor progression.

The phrase "androgen receptor modulators" refers to compounds that interfere or inhibit the binding of androgens to the receptor, regardless of mechanism.

The phrase "angiogenesis inhibitors" refers to compounds that inhibit the formation of new blood vessels, regardless of mechanism.

The term "aryl" as used herein refers to its meaning as is generally accepted in the art. The term generally refers to an aromatic group that has at least one ring having a conjugated pi electron system and includes carbocyclic aryl, heterocyclic aryl and biaryl groups, all of which can be optionally substituted. The preferred substituent(s) of aryl groups are halogen, trihalomethyl, hydroxyl, SH, OH, cyano, C1-C4 alkoxy, C1-C4 alkyl, C2-C4 alkenyl, C2-C4 alkynyl, $NH_2$, and $NR_1R_2$ groups, where $R_1$ and $R_2$ independently are H or C1-C4 alkyl.

The term "alkylaryl" as used herein refers to its meaning as is generally accepted in the art. The term generally refers to an alkyl group (as described above) covalently joined to an aryl group (as described above). Carbocyclic aryl groups are groups wherein the ring atoms on the aromatic ring are all carbon atoms. The carbon atoms are optionally substituted. Heterocyclic aryl groups are groups having from 1 to 3 heteroatoms as ring atoms in the aromatic ring and the remainder of the ring atoms are carbon atoms. Suitable heteroatoms include oxygen, sulfur, and nitrogen, and examples of heterocyclic aryl groups having such heteroatoms include furanyl, thienyl, pyridyl, pyrrolyl, N-lower alkyl pyrrolo, pyrimidyl, pyrazinyl, imidazolyl and the like, all optionally substituted. Preferably, the alkyl group is a C1-C4 alkyl group.

The term "amide" as used herein refers to its meaning as is generally accepted in the art. The term generally refers to an —C(O)—NH—R, where R is either alkyl, aryl, alkylaryl or hydrogen.

The phrase "antisense region" as used herein refers to its meaning as is generally accepted in the art. With reference to exemplary nucleic acid molecules of the invention, the term refers to a nucleotide sequence of an siNA molecule having complementarity to a target nucleic acid sequence. In addition, the antisense region of an siNA molecule can optionally comprise a nucleic acid sequence having complementarity to a sense region of the siNA molecule. In one embodiment, the antisense region of the siNA molecule is referred to as the antisense strand or guide strand.

The phrase "asymmetric hairpin" refers to a linear siNA molecule comprising an antisense region, a loop portion that can comprise nucleotides or non-nucleotides, and a sense region that comprises fewer nucleotides than the antisense region to the extent that the sense region has enough complementary nucleotides to base pair with the antisense region and form a duplex with loop. For example, an asymmetric hairpin siNA molecule of the invention can comprise an antisense region having length sufficient to mediate RNAi in a cell or in vitro system (e.g. about 15 to about 30, or about 15, 16, 17, 18, 19, 20, 21, 22, 23, 24, 25, 26, 27, 28, 29, or 30 nucleotides) and a loop region comprising about 4 to about 12 (e.g., about 4, 5, 6, 7, 8, 9, 10, 11, or 12) nucleotides, and a sense region having about 3 to about 25 (e.g., about 3, 4, 5, 6, 7, 8, 9, 10, 11, 12, 13, 14, 15, 16, 17, 18, 19, 20, 21, 22, 23, 24, or 25) nucleotides that are complementary to the antisense region. The asymmetric hairpin siNA molecule can also comprise a 5'-terminal phosphate group that can be chemically modified. The loop portion of the asymmetric hairpin siNA molecule can comprise nucleotides, non-nucleotides, linker molecules, or conjugate molecules as described herein.

The term "biodegradable" as used herein refers to its meaning as is generally accepted in the art. The term generally refers to degradation in a biological system, for example, enzymatic degradation or chemical degradation.

The term "biodegradable linker" as used herein refers to its meaning as is generally accepted in the art. With reference to exemplary nucleic acid molecules of the invention, the term refers to a linker molecule that is designed to connect one molecule to another molecule, and which is susceptible to degradation in a biological system. The linker can be a nucleic acid or non-nucleic acid based linker. For example, a biodegradable linker can be used to attach a ligand or biologically active molecule to an siNA molecule of the invention. Alternately, a biodegradable linker can be used to connect the sense and antisense strands of an siNA molecule of the invention. The biodegradable linker is designed such that its stability can be modulated for a particular purpose, such as delivery to a particular tissue or cell type. The stability of a nucleic acid-based biodegradable linker molecule can be modulated by using various chemistries, for example combinations of ribonucleotides, deoxyribonucleotides, and chemically modified nucleotides, such as 2'-O-methyl, 2'-fluoro, 2'-amino, 2'-O-amino, 2'-C-allyl, 2'-O-allyl, and other 2'-modified or base modified nucleotides. The biodegradable nucleic acid linker molecule can be a dimer, trimer, tetramer or longer nucleic acid molecule, for example, an oligonucleotide of about 2, 3, 4, 5, 6, 7, 8, 9, 10, 11, 12, 13, 14, 15, 16, 17, 18, 19, or 20 nucleotides in length, or can comprise a single nucleotide with a phosphorus-based linkage, for example, a phosphoramidate or phosphodiester linkage. The biodegradable nucleic acid linker molecule can also comprise nucleic acid backbone, nucleic acid sugar, or nucleic acid base modifications.

The phrase "biologically active molecule" as used herein refers to its meaning as is generally accepted in the art. With reference to exemplary nucleic acid molecules of the invention, the term refers to compounds or molecules that are capable of eliciting or modifying a biological response in a system and/or are capable of modulating the pharmacokinetics and/or pharmacodynamics of other biologically active molecules. Examples of biologically active molecules, include siNA molecules alone or in combination with other molecules including, but not limited to therapeutically active molecules such as antibodies, cholesterol, hormones, antivirals, peptides, proteins, chemotherapeutics, small molecules, vitamins, co-factors, nucleosides, nucleotides, oligonucleotides, enzymatic nucleic acids, antisense nucleic acids, triplex forming oligonucleotides, polyamines, polyamides, polyethylene glycol, other polyethers, 2-5A chimeras, siNA, dsRNA, allozymes, aptamers, decoys and analogs thereof.

The phrase "biological system" as used herein refers to its meaning as is generally accepted in the art. The term generally refers to material, in a purified or unpurified form, from biological sources including, but not limited to, human or animal, wherein the system comprises the components required for RNAi activity. Thus, the phrase includes, for example, a cell, tissue, subject, or organism, or extract thereof. The term also includes reconstituted material from a biological source.

The phrase "blunt end" as used herein refers to its meaning as is generally accepted in the art. With reference to exemplary nucleic acid molecules of the invention, the term refers to termini of a double-stranded siNA molecule having no overhanging nucleotides. For example, the two strands of a double-stranded siNA molecule having blunt ends align with each other with matched base-pairs without overhanging nucleotides at the termini. A siNA duplex molecule of the invention can comprise blunt ends at one or both termini of the duplex, such as termini located at the 5'-end of the antisense strand, the 5'-end of the sense strand, or both termini of the duplex.

The term "cap" also referred to herein as "terminal cap," as used herein refers to its meaning as is generally accepted in the art. With reference to exemplary nucleic acid molecules of the invention, the term refers to a moiety, which can be a chemically modified nucleotide or non-nucleotide that can be incorporated at one or more termini of one or more nucleic acid molecules of the invention. These terminal modifications protect the nucleic acid molecule from exonuclease degradation, and can help in delivery and/or localization within a cell. The cap can be present at the 5'-terminus (5'-cap) or at the 3'-terminal (3'-cap) or can be present on both termini of any nucleic acid molecule of the invention. A cap can be present at the 5'-end, 3-end and/or 5' and 3'-ends of the sense strand of a nucleic acid molecule of the invention. Additionally, a cap can optionally be present at the 3'-end of the antisense strand of a nucleic acid molecule of the invention. In non-limiting examples, the 5'-cap includes, but is not limited to, LNA; glyceryl; inverted deoxy abasic residue (moiety); 4',5'-methylene nucleotide; 1-(beta-D-erythrofuranosyl) nucleotide, 4'-thio nucleotide; carbocyclic nucleotide; 1,5-anhydrohexitol nucleotide; L-nucleotides; alpha-nucleotides; modified base nucleotide; phosphorodithioate linkage; threo-pentofuranosyl nucleotide; acyclic 3',4'-seco nucleotide; acyclic 3,4-dihydroxybutyl nucleotide; acyclic 3,5-dihydroxypentyl nucleotide; 3'-3'-inverted nucleotide moiety; 3'-3'-inverted abasic moiety; 3'-2'-inverted nucleotide moiety; 3'-2'-inverted abasic moiety; 1,4-butanediol phosphate; 3'-phosphoramidate; hexylphosphate; aminohexyl phosphate; 3'-phosphate; 3'-phosphorothioate; phosphorodithioate; or bridging or non-bridging methylphosphonate moiety. Non-limiting examples of the 3'-cap include, but are not limited to, LNA; glyceryl; inverted deoxy abasic residue (moiety); 4',5'-methylene nucleotide; 1-(beta-D-erythrofuranosyl) nucleotide; 4'-thio nucleotide; carbocyclic nucleotide; 5'-amino-alkyl phosphate; 1,3-diamino-2-propyl phosphate; 3-aminopropyl phosphate; 6-aminohexyl phosphate; 1,2-aminododecyl phosphate; hydroxypropyl phosphate; 1,5-anhydrohexitol nucleotide; L-nucleotide; alpha-nucleotide; modified base nucleotide; phosphorodithioate; threo-pentofuranosyl nucleotide; acyclic 3',4'-seco nucleotide; 3,4-dihydroxybutyl nucleotide; 3,5-dihydroxypentyl nucleotide, 5'-5'-inverted nucleotide moiety; 5'-5'-inverted abasic moiety; 5'-phosphoramidate; 5'-phosphorothioate; 1,4-butanediol phosphate; 5'-amino; bridging and/or non-bridging 5'-phosphoramidate; phosphorothioate and/or phosphorodithioate; bridging or non bridging methylphosphonate; and 5'-mercapto moieties (for more details see Beaucage and Iyer, 1993, Tetrahedron 49, 1925; incorporated by reference herein). FIG. 5 shows some non-limiting examples of various caps.

The term "cell" as used herein refers to its meaning as is generally accepted in the art. With reference to exemplary nucleic acid molecules of the invention, the term is used in its usual biological sense, and does not refer to an entire multicellular organism, e.g., specifically does not refer to a human being. The cell can be present in an organism, e.g., birds, plants and mammals, such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell.

The phrase "chemical modification" as used herein refers to its meaning as is generally accepted in the art. With reference to exemplary nucleic acid molecules of the invention, the term refers to any modification of the chemical structure of the nucleotides that differs from nucleotides of native siRNA or RNA in general. The term "chemical modification" encompasses the addition, substitution, or modification of native siRNA or RNA at the sugar, base, or internucleotide linkage, as described herein or as is otherwise known in the art. In certain embodiments, the term "chemical modification" can refer to certain forms of RNA that are naturally occurring in certain biological systems, for example 2'-O-methyl modifications or inosine modifications.

The term "complementarity" or "complementary" as used herein refers to its meaning as is generally accepted in the art. With reference to exemplary nucleic acid molecules of the invention, the terms generally refer to the formation or existence of hydrogen bond(s) between one nucleic acid sequence and another nucleic acid sequence by either traditional Watson-Crick or other non-traditional types of bonding as described herein. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, *CSH Symp. Quant. Biol.* LII pp. 123-133; Frier et al., 1986, *Proc. Nat. Acad. Sci. USA* 83:9373-9377; Turner et al., 1987, *J. Am. Chem. Soc.* 109:3783-3785). Perfect complementary means that all the contiguous residues of a nucleic acid sequence will hydrogen bond with the same number of contiguous residues in a second nucleic acid sequence. Partial complementarity can include various mismatches or non-based paired nucleotides (e.g., 1, 2, 3, 4, 5, 6, 7, 8, 9, 10 or more mismatches, non-nucleotide linkers, or non-based paired nucleotides) within the nucleic acid molecule, which can result in bulges, loops, or overhangs that result between the sense strand or sense region and the antisense strand or antisense region of the nucleic acid molecule or between the antisense strand or antisense region of the nucleic acid molecule and a corresponding target nucleic acid molecule. Such partial complementarity can be represented by a % complementarity that is determined by the number of non-base paired nucleotides, i.e., about 50%, 60%, 70%, 80%, 90% etc. depending on the total number of nucleotides involved. Such partial complementarity is permitted to the extent that the nucleic acid molecule (e.g., siNA) maintains its function, for example the ability to mediate sequence specific RNAi.

The terms "composition" or "formulation" as used herein refer to their generally accepted meaning in the art. These terms generally refer to a composition or formulation, such as in a pharmaceutically acceptable carrier or diluent, in a form suitable for administration, e.g., systemic or local administration, into a cell or subject, including, for example, a human. Suitable forms, in part, depend upon the use or the route of entry, for example oral, transdermal, inhalation, or by injection. Such forms should not prevent the composition or formulation from reaching a target cell (i.e., a cell to which the negatively charged nucleic acid is desirable for delivery). For example, compositions injected into the blood stream should be soluble. Other factors are known in the art, and include considerations such as toxicity and forms that prevent the composition or formulation from exerting its effect. As used herein, pharmaceutical formulations include formulations for human and veterinary use. Non-limiting examples of agents suitable for formulation with the nucleic acid molecules of the instant invention include: Lipid Nanoparticles (see for example Semple et al., 2010, *Nat. Biotechnol., February;* 28(2):172-6.); P-glycoprotein inhibitors (such as Pluronic P85); biodegradable polymers, such as poly (DL-lactide-coglycolide) microspheres for sustained release delivery (Emerich, D F et al, 1999, *Cell Transplant,* 8, 47-58); and loaded nanoparticles, such as those made of polybutylcyanoacrylate. Other non-limiting examples of delivery strategies for the nucleic acid molecules of the instant invention include material described in Boado et al., 1998, *J. Pharm. Sci.,* 87, 1308-1315; Tyler et al., 1999, *FEBS Lett.,* 421, 280-284; Pardridge et al., 1995, *PNAS USA.,* 92, 5592-5596; Boado, 1995, *Adv. Drug Delivery Rev.,* 15, 73-107; Aldrian-Herrada et al., 1998, *Nucleic Acids Res.,* 26, 4910-4916; and Tyler et al., 1999, *PNAS USA.,* 96, 7053-7058. A "pharmaceutically acceptable composition" or "pharmaceutically acceptable formulation" can refer to a composition or formulation that allows for the effective distribution of the nucleic acid molecules of the instant invention to the physical location most suitable for their desired activity.

The phrase "cytotoxic/cytostatic agents" refer to compounds that cause cell death or inhibit cell proliferation primarily by interfering directly with the cell's functioning or inhibit or interfere with cell mytosis, including alkylating agents, tumor necrosis factors, intercalators, hypoxia activatable compounds, microtubule inhibitors/microtubule-stabilizing agents, inhibitors of mitotic kinesins, inhibitors of histone deacetylase, inhibitors of kinases involved in mitotic progression, antimetabolites; biological response modifiers; hormonal/anti-hormonal therapeutic agents, hematopoietic growth factors, monoclonal antibody targeted therapeutic agents, topoisomerase inhibitors, proteasome inhibitors and ubiquitin ligase inhibitors.

The phrase "estrogen receptor modulators" refers to compounds that interfere with or inhibit the binding of estrogen to the receptor, regardless of mechanism.

The term "gene" or "target gene" as used herein refers to their meaning as is generally accepted in the art. The terms generally refer a nucleic acid (e.g., DNA or RNA) sequence that comprises partial length or entire length coding sequences necessary for the production of a polypeptide. The target gene can also include the UTR or non-coding region of the nucleic acid sequence. A gene or target gene can also encode a functional RNA (fRNA) or non-coding RNA (ncRNA), such as small temporal RNA (stRNA), micro RNA (miRNA), small nuclear RNA (snRNA), short interfering RNA (siRNA), small nucleolar RNA (snRNA), ribosomal RNA (rRNA), transfer RNA (tRNA) and precursor RNAs thereof. Such non-coding RNAs can serve as target nucleic acid molecules for siNA mediated RNA interference in modulating the activity of fRNA or ncRNA involved in functional or regulatory cellular processes. Aberrant fRNA or ncRNA activity leading to disease can therefore be modulated by siNA molecules of the invention. siNA molecules targeting fRNA and ncRNA can also be used to manipulate or alter the genotype or phenotype of a subject, organism or cell, by intervening in cellular processes such as genetic imprinting, transcription, translation, or nucleic acid processing (e.g., transamination, methylation etc.). The target gene can be a gene derived from a cell, an endogenous gene, a transgene, or exogenous genes such as genes of a pathogen, for example a virus, which is present in the cell after infection thereof. The cell containing the target gene can be derived from or contained in any organism, for example a plant, animal, protozoan, virus, bacterium, or fungus. Non-limiting examples of plants include monocots, dicots, or gymnosperms. Non-limiting examples of animals include vertebrates or invertebrates. Non-limiting examples of fungi include molds or yeasts. For a review, see for example Snyder and Gerstein, 2003, *Science,* 300, 258-260.

The phrase "HMG-CoA reductase inhibitors" refers to inhibitors of 3-hydroxy-3-methylglutaryl-CoA reductase. The term HMG-CoA reductase inhibitor as used herein includes all pharmaceutically acceptable lactone and open-acid forms (i.e., where the lactone ring is opened to form the free acid) as well as salt and ester forms of compounds that have HMG-CoA reductase inhibitory activity, and therefore the use of such salts, esters, open-acid and lactone forms is included within the scope of this invention.

The term "HBV" refers to Hepatitis B Virus, which is gene that encodes HBV proteins, HBV peptides, HBV polypeptides, HBV regulatory polynucleotides (e.g., HBV miRNAs and siNAs), mutant HBV genes, and splice variants of a HBV genes, as well as other genes involved in HBV pathways of gene expression and/or activity. Thus, each of the embodiments described herein with reference to the term "HBV" are applicable to all of the protein, peptide, polypeptide, and/or polynucleotide molecules covered by the term "HBV", as that term is defined herein. Comprehensively, such gene targets are also referred to herein generally as "target" sequences (including the target sequences listed in Table 1a).

The phrase "highly conserved sequence region" refers to a nucleotide sequence of one or more regions in a target gene that does not vary significantly from one generation to the other or from one biological system to the other.

The phrase "homologous sequence" as used herein refers to its meaning as is generally accepted in the art. The term generally refers a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes. A homologous sequence can be a nucleotide sequence that is shared by two or more non-coding polynucleotides, such as noncoding DNA or RNA, regulatory sequences, introns, and sites of transcriptional control or regulation. Homologous sequences can also include sequence regions shared by more than one polynucleotide sequence. Homology does not need to be perfect identity (100%), as partially homologous sequences are also contemplated by and within the scope of the instant invention (e.g., at least 95%, 94%, 93%, 92%, 91%, 90%, 89%, 88%, 87%, 86%, 85%, 84%, 83%, 82%, 81%, 80% etc.). Percent homology is the number of matching nucleotides between two sequences divided by the total length being compared, multiplied by 100.

The phrase "improved RNAi activity" refers to an increase in RNAi activity measured in vitro and/or in vivo, where the RNAi activity is a reflection of both the ability of the siNA to mediate RNAi and the stability of the siNAs of the invention. In this invention, the product of these activities can be increased in vitro and/or in vivo compared to an all RNA siNA or an siNA containing a plurality of ribonucleotides. In some cases, the activity or stability of the siNA molecule can be decreased (i.e., less than ten-fold), but the overall activity of the siNA molecule is enhanced in vitro and/or in vivo.

The terms "inhibit," "down-regulate," or "reduce" as used herein refers to its meaning as is generally accepted in the art. With reference to exemplary nucleic acid molecules of the invention, he term generally refers the reduction in the expression of the gene, or level of RNA molecules or equivalent RNA molecules encoding one or more proteins or protein subunits, or activity of one or more proteins or protein subunits, below that observed in the absence of the nucleic acid molecules (e.g., siNA) of the invention. Down-regulation can also be associated with post-transcriptional silencing, such as, RNAi mediated cleavage or by alteration in DNA methylation patterns or DNA chromatin structure Inhibition, down-regulation or reduction with an siNA molecule can be in reference to an inactive molecule, an attenuated molecule, an siNA molecule with a scrambled sequence, or an siNA molecule with mismatches or alternatively, it can be in reference to the system in the absence of the nucleic acid.

The phrase "inhibitors of cell proliferation and survival signaling pathway" refers to pharmaceutical agents that inhibit cell surface receptors and signal transduction cascades downstream of those surface receptors.

The term "integrin blockers" refers to compounds which selectively antagonize, inhibit or counteract binding of a physiological ligand to the $\alpha_\nu\beta_3$ integrin, to compounds which selectively antagonize, inhibit or counteract binding of a physiological ligand to the $\alpha_\nu\beta_5$ integrin, to compounds which antagonize, inhibit or counteract binding of a physiological ligand to both the $\alpha_\nu\beta_3$ integrin and the $\alpha_\nu\beta_5$ integrin, and to compounds which antagonize, inhibit or counteract the activity of the particular integrin(s) expressed on capillary endothelial cells. The term also refers to antagonists of the $\alpha_\nu\beta_6\alpha_\nu\beta_8\alpha_1\beta_1\alpha_5\beta_1\alpha_5\beta_1\alpha_6\beta_1$ and $\alpha_6\beta_4$ integrins. The term also refers to antagonists of any combination of $\alpha_\nu\beta_3$, $\alpha_\nu\beta_5$, $\alpha_\nu\beta_6\alpha_\nu\beta_8\alpha_1\beta_1\alpha_2\beta_1\alpha_5\beta_1\alpha_6\beta_1$ and $\alpha_6\beta_4$ integrins.

The terms "intermittent" or "intermittently" as used herein refers to its meaning as is generally accepted in the art. The term generally refers to periodic stopping and starting at either regular or irregular intervals.

The terms "internucleoside linkage" or "internucleoside linker" or "internucleotide linkage" or "internucleotide linker" are used herein interchangeably and refer to any linker or linkage between two nucleoside units, as is known in the art, including, for example, but not limitation, phosphate, analogs of phosphate, phosphonate, guanidium, hydroxylamine, hydroxylhydrazinyl, amide, carbamate, alkyl, and substituted alkyl linkages. The internucleoside linkages constitute the backbone of a nucleic acid molecule.

The terms "mammalian" or "mammal" as used herein refers to its meaning as is generally accepted in the art. The term generally refers to any warm blooded vertebrate species, such as a human, mouse, rat, dog, cat, hamster, guinea pig, rabbit, livestock, and the like.

The phrase "metered dose inhaler" or MDI refers to a unit comprising a can, a secured cap covering the can and a formulation metering valve situated in the cap. MDI systems includes a suitable channeling device. Suitable channeling devices comprise for example, a valve actuator and a cylindrical or cone-like passage through which medicament can be delivered from the filled canister via the metering valve to the nose or mouth of a patient such as a mouthpiece actuator.

The term "microRNA" or "miRNA" as used herein refers to its meaning as is generally accepted in the art. The term generally refers a small double-stranded RNA that regulates the expression of target messenger RNAs either by mRNA cleavage, translational repression/inhibition or heterochromatic silencing (see for example Ambros, 2004, Nature, 431, 350-355; Bartel, 2004, Cell, 116, 281-297; Cullen, 2004, Virus Research., 102, 3-9; He et al., 2004, Nat. Rev. Genet., 5, 522-531; Ying et al., 2004, Gene, 342, 25-28; and Sethupathy et al., 2006, RNA, 12:192-197).

The term "modulate" as used herein refers to its meaning as is generally accepted in the art. With reference to exemplary nucleic acid molecules of the invention, the term refers to when the expression of a gene, or level of one or more RNA molecules (coding or non-coding), or activity of one or more RNA molecules or proteins or protein subunits, is up-regulated or down-regulated, such that expression, level, or activity is greater than or less than that observed in the absence of the molecule that effects modulation. For example, the term "modulate" in some embodiments can refer to inhibition and in other embodiments can refer to potentiation or up-regulation, e.g., of gene expression.

The phrase "modified nucleotide" as used herein refers to its meaning as is generally accepted in the art. The term generally refers a nucleotide, which contains a modification in the chemical structure of the base, sugar and/or phosphate of the unmodified (or natural) nucleotide as is generally known in the art. Non-limiting examples of modified nucleotides are described herein and in U.S. application Ser. No. 12/064,014.

The phrase "NSAIDs that are selective COX-2 inhibitors" for purposes herein, refers to NSAIDs, which possess a specificity for inhibiting COX-2 over COX-1 of at least 100 fold as measured by the ratio of $IC_{50}$ for COX-2 over $IC_{50}$ for COX-1 evaluated by cell or microsomal assays.

The phrase "non-base paired" refers to nucleotides that are not base paired between the sense strand or sense region and the antisense strand or antisense region of an double-stranded siNA molecule; and can include for example, but not limitation, mismatches, overhangs, single stranded loops, etc.

The term "non-nucleotide" refers to any group or compound which can be incorporated into a nucleic acid chain in the place of one or more nucleotide units, such as for example but not limitation abasic moieties or alkyl chains. The group or compound is "abasic" in that it does not contain a commonly recognized nucleotide base, such as adenosine, guanine, cytosine, uracil or thymine and therefore lacks a nucleobase at the 1'-position.

The term "nucleotide" is used as is generally recognized in the art. Nucleotides generally comprise a nucleobase, a sugar, and an internucleoside linkage, e.g., a phosphate. The base can be a natural bases (standard), modified bases, or a base analog, as are well known in the art. Such bases are generally located at the 1' position of a nucleotide sugar moiety. Additionally, the nucleotides can be unmodified or modified at the sugar, internucleoside linkage, and/or base moiety, (also referred to interchangeably as nucleotide analogs, modified nucleotides, non-natural nucleotides, non-standard nucleotides and others; see, for example, U.S. application Ser. No. 12/064,014.

The term "overhang" as used herein refers to its meaning as is generally accepted in the art. With reference to exemplary double stranded nucleic acid molecules, the term generally refers to the terminal portion of a nucleotide sequence that is not base paired between the two strands of a double-stranded nucleic acid molecule (see for example, FIG. 4). Overhangs, when present, are typically at the 3'-end of one or both strands in a siNA duplex.

The term "parenteral" as used herein refers to its meaning as is generally accepted in the art. The term generally refers methods or techniques of administering a molecule, drug, agent, or compound in a manner other than through the digestive tract, and includes epicutaneous, subcutaneous, intravascular (e.g., intravenous), intramuscular, or intrathecal injection or infusion techniques and the like.

The phrase "pathway target" refers to any target involved in pathways of gene expression or activity. For example, any given target can have related pathway targets that can include upstream, downstream, or modifier genes in a biologic pathway. These pathway target genes can provide additive or synergistic effects in the treatment of diseases, conditions, and traits herein.

The term "phosphorothioate" refers to an internucleotide phosphate linkage comprising one or more sulfur atoms in place of an oxygen atom. Hence, the term phosphorothioate refers to both phosphorothioate and phosphorodithioate internucleotide linkages.

"Prenyl-protein transferase inhibitor" refers to a compound that inhibits any one or any combination of the prenyl-protein transferase enzymes, including farnesyl-protein transferase (FPTase), geranylgeranyl-protein transferase type I (GGPTase-I), and geranylgeranyl-protein transferase type-II (GGPTase-II, also called Rab GGPTase).

The phrase "retinoid receptor modulators" refers to compounds that interfere or inhibit the binding of retinoids to the receptor, regardless of mechanism.

The term "ribonucleotide" as used herein refers to its meaning as is generally accepted in the art. The term generally refers to a nucleotide with a hydroxyl group at the 2' position of a β-D-ribofuranose moiety.

The term "RNA" as used herein refers to its generally accepted meaning in the art. Generally, the term RNA refers to a molecule comprising at least one ribofuranoside moiety. The term can include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the siNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

The phrase "RNA interference" or term "RNAi" refer to the biological process of inhibiting or down regulating gene expression in a cell, as is generally known in the art, and which is mediated by short interfering nucleic acid molecules, see for example Zamore and Haley, 2005, *Science*, 309, 1519-1524; Vaughn and Martienssen, 2005, *Science*, 309, 1525-1526; Zamore et al., 2000, *Cell*, 101, 25-33; Bass, 2001, *Nature*, 411, 428-429; Elbashir et al., 2001, *Nature*, 411, 494-498; and Kreutzer et al., International PCT Publication No. WO 00/44895; Zernicka-Goetz et al., International PCT Publication No. WO 01/36646; Fire, International PCT Publication No. WO 99/32619; Plaetinck et al., International PCT Publication No. WO 00/01846; Mello and Fire, International PCT Publication No. WO 01/29058; Deschamps-Depaillette, International PCT Publication No. WO 99/07409; and Li et al., International PCT Publication No. WO 00/44914; Allshire, 2002, *Science*, 297, 1818-1819; Volpe et al., 2002, *Science*, 297, 1833-1837; Jenuwein, 2002, *Science*, 297, 2215-2218; and Hall et al., 2002, *Science*, 297, 2232-2237; Hutvagner and Zamore, 2002, *Science*, 297, 2056-60; McManus et al., 2002, *RNA*, 8, 842-850; Reinhart et al., 2002, *Gene & Dev.*, 16, 1616-1626; and Reinhart & Bartel, 2002, *Science*, 297, 1831). Additionally, the term RNAi is meant to be equivalent to other terms used to describe sequence specific RNA interference, such as post transcriptional gene silencing, translational inhibition, transcriptional inhibition, or epigenetics. For example, siNA molecules of the invention can be used to epigenetically silence genes at either the post-transcriptional level or the pre-transcriptional level. In a non-limiting example, epigenetic modulation of gene expression by siNA molecules of the invention can result from siNA mediated modification of chromatin structure or methylation patterns to alter gene expression (see, for example, Verdel et al., 2004, *Science*, 303, 672-676; Pal-Bhadra et al., 2004, *Science*, 303, 669-672; Allshire, 2002, *Science*, 297, 1818-1819; Volpe et al., 2002, *Science*, 297, 1833-1837; Jenuwein, 2002, *Science*, 297, 2215-2218; and Hall et al., 2002, *Science*, 297, 2232-2237). In another non-limiting example, modulation of gene expression by siNA molecules of the invention can result from siNA mediated cleavage of RNA (either coding or non-coding RNA) via RISC, or via translational inhibition, as is known in the art or modulation can result from transcriptional inhibition (see for example Janowski et al., 2005, *Nature Chemical Biology*, 1, 216-222).

The phrase "RNAi inhibitor" refers to any molecule that can down regulate, reduce or inhibit RNA interference function or activity in a cell or organism. An RNAi inhibitor can down regulate, reduce or inhibit RNAi (e.g., RNAi mediated cleavage of a target polynucleotide, translational inhibition, or transcriptional silencing) by interaction with or interfering with the function of any component of the RNAi pathway, including protein components such as RISC, or nucleic acid components such as miRNAs or siRNAs. A RNAi inhibitor can be an siNA molecule, an antisense molecule, an aptamer, or a small molecule that interacts with or interferes with the function of RISC, a miRNA, or an siRNA or any other component of the RNAi pathway in a cell or organism. By inhibiting RNAi (e.g., RNAi mediated cleavage of a target polynucleotide, translational inhibition, or transcriptional silencing), a RNAi inhibitor of the invention can be used to modulate (e.g., up-regulate or down regulate) the expression of a target gene.

The phrase "sense region" as used herein refers to its meaning as is generally accepted in the art. With reference to exemplary nucleic acid molecules of the invention, the term refers to a nucleotide sequence of an siNA molecule having complementarity to an antisense region of the siNA molecule.

In addition, the sense region of an siNA molecule can comprise a nucleic acid sequence having homology or sequence identity with a target nucleic acid sequence. In one embodiment, the sense region of the siNA molecule is also referred to as the sense strand or passenger strand.

The phrases "short interfering nucleic acid", "siNA", "short interfering RNA", "siRNA", "short interfering nucleic acid molecule", "short interfering oligonucleotide molecule", or "chemically modified short interfering nucleic acid molecule" refer to any nucleic acid molecule capable of inhibiting or down regulating gene expression or viral replication by mediating RNA interference ("RNAi") or gene silencing in a sequence-specific manner. These terms can refer to both individual nucleic acid molecules, a plurality of such nucleic acid molecules, or pools of such nucleic acid molecules. The siNA can be a double-stranded nucleic acid molecule comprising self-complementary sense and antisense strands, wherein the antisense strand comprises a nucleotide sequence that is complementary to a nucleotide sequence in a target nucleic acid molecule or a portion thereof and the sense strand comprises a nucleotide sequence corresponding to the target nucleic acid sequence or a portion thereof. The siNA can be a polynucleotide with a duplex, asymmetric duplex, hairpin or asymmetric hairpin secondary structure, having self-complementary sense and antisense regions, wherein the antisense region comprises a nucleotide sequence that is complementary to a nucleotide sequence in a separate target nucleic acid molecule or a portion thereof and the sense region comprises a nucleotide sequence corresponding to the target nucleic acid sequence or a portion thereof. The siNA can be a circular single-stranded polynucleotide having two or more loop structures and a stem comprising self-complementary sense and antisense regions, wherein the antisense region comprises nucleotide sequence that is complementary to a nucleotide sequence in a target nucleic acid molecule or a portion thereof and the sense region comprises a nucleotide sequence corresponding to the target nucleic acid sequence or a portion thereof, and wherein the circular polynucleotide can be processed either in vivo or in vitro to generate an active siNA molecule capable of mediating RNAi. The siNA can also comprise a single-stranded polynucleotide having a nucleotide sequence complementary to nucleotide sequence in a target nucleic acid molecule or a portion thereof (for example, where such siNA molecule does not require the presence within the siNA molecule of a nucleotide sequence corresponding to the target nucleic acid sequence or a portion thereof), wherein the single-stranded polynucleotide can further comprise a terminal phosphate group, such as a 5'-phosphate (see for example, Martinez et al., 2002, *Cell*, 110, 563-574 and Schwarz et al., 2002, *Molecular Cell*, 10, 537-568), or 5',3'-diphosphate.

The term "subject" as used herein refers to its meaning as is generally accepted in the art. The term generally refers an organism to which the nucleic acid molecules of the invention can be administered. A subject can be a mammal or mammalian cells, including a human or human cells. The term also refers to an organism, which is a donor or recipient of explanted cells or the cells themselves.

The phrase "systemic administration" as used herein refers to its meaning as is generally accepted in the art. The term generally refers in vivo systemic absorption or accumulation of drugs in the blood stream followed by distribution throughout the entire body.

The term "target" as it refers to HBV refers to any HBV target protein, peptide, or polypeptide, such as encoded by Genbank Accession Nos. shown in Table 7. The term also refers to nucleic acid sequences or target polynucleotide sequence encoding any target protein, peptide, or polypeptide, such as proteins, peptides, or polypeptides encoded by sequences having Genbank Accession Nos. shown in Table 7. The target of interest can include target polynucleotide sequences, such as target DNA or target RNA. The term "target" is also meant to include other sequences, such as differing isoforms, mutant target genes, splice variants of target polynucleotides, target polymorphisms, and non-coding (e.g., ncRNA, miRNA, stRNA, sRNA) or other regulatory polynucleotide sequences as described herein.

The phrase "target site" as used herein refers to its meaning as is generally accepted in the art. The term generally refers to a sequence within a target nucleic acid molecule, (e.g., RNA) that is "targeted", e.g., for cleavage mediated by an siNA construct, which contains sequences within its antisense region that are complementary to the target sequence.

The phrase "therapeutically effective amount" as used herein refers to its meaning as is generally accepted in the art. The term generally refers to the amount of the compound or composition that will elicit the biological or medical response of a cell, tissue, system, animal or human that is be sought by the researcher, veterinarian, medical doctor or other clinician. For example, if a given clinical treatment is considered effective when there is at least a 25% reduction in a measurable parameter associated with a disease or disorder, a therapeutically effective amount of a drug for the treatment of that disease or disorder is that amount necessary to effect at least a 25% reduction in that parameter.

The phrase "universal base" as used herein refers to its meaning as is generally accepted in the art. The term universal base generally refers to nucleotide base analogs that form base pairs with each of the natural DNA/RNA bases with little or no discrimination between them. Non-limiting examples of universal bases include C-phenyl, C-naphthyl and other aromatic derivatives, inosine, azole carboxamides, and nitroazole derivatives such as 3-nitropyrrole, 4-nitroindole, 5-nitroindole, and 6-nitroindole as known in the art (see for example, Loakes, 2001, *Nucleic Acids Research*, 29, 2437-2447).

The term "up-regulate" as used herein refers to its meaning as is generally accepted in the art. With reference to exemplary nucleic acid molecules of the invention, the term refers to an increase in the expression of a gene, or level of RNA molecules or equivalent RNA molecules encoding one or more proteins or protein subunits, or activity of one or more RNAs, proteins or protein subunits, above that observed in the absence of the nucleic acid molecules (e.g., siNA) of the invention. In certain instances, up-regulation or promotion of gene expression with an siNA molecule is above that level observed in the presence of an inactive or attenuated molecule. In other instances, up-regulation or promotion of gene expression with siNA molecules is above that level observed in the presence of, for example, an siNA molecule with scrambled sequence or with mismatches. In still other instances, up-regulation or promotion of gene expression with a nucleic acid molecule of the instant invention is greater in the presence of the nucleic acid molecule than in its absence. In some instances, up-regulation or promotion of gene expression is associated with inhibition of RNA mediated gene silencing, such as RNAi mediated cleavage or silencing of a coding or non-coding RNA target that down regulates, inhibits, or silences the expression of the gene of interest to be up-regulated. The down regulation of gene expression can, for example, be induced by a coding RNA or its encoded protein, such as through negative feedback or antagonistic effects. The down regulation of gene expression can, for example, be induced by a non-coding RNA having regulatory control over a gene of interest, for example by silencing expression of the gene via translational inhibition, chromatin structure, methylation, RISC mediated RNA cleavage, or translational inhibition. As such, inhibition or down regulation of targets that down regulate, suppress, or silence a gene of interest can be used to up-regulate expression of the gene of interest toward therapeutic use.

The term "vector" as used herein refers to its meaning as is generally accepted in the art. The term vector generally refers to any nucleic acid- and/or viral-based expression system or technique used to deliver one or more nucleic acid molecules.

B. siNA Molecules of the Invention

The present invention provides compositions and methods comprising siNAs targeted to HBV that can be used to treat diseases, e.g., liver disease or malignancies and/or cancers associated with HBV expression or other conditions that result from hepatitis B infection. In particular aspects and embodiments of the invention, the nucleic acid molecules of the invention comprise at least a 15 nucleotide sequence of the sequences shown in Table 1a and Table 1b. The siNAs can be provided in several forms. For example, the siNA can be isolated as one or more siNA compounds, or it may be in the form of a transcriptional cassette in a DNA plasmid. The siNA may also be chemically synthesized and can include modifications as shown, for example, but not limitation, in Table 1c and Table 8. Thus, in various embodiments, at least one strand or region of the nucleic acids of the invention comprises at least a 15 nucleotide sequence selected from the group of sequences consisting of SEQ ID NOS:1-502. The siNAs can be administered alone or co-administered with other siNA molecules or with conventional agents that treat a HBV related disease or condition.

The siNA molecules of the invention can be used to mediate gene silencing, specifically HBV, via interaction with RNA transcripts or alternately by interaction with particular gene sequences, wherein such interaction results in modulation of gene silencing either at the transcriptional level or post-transcriptional level such as, for example, but not limited to, RNAi or through cellular processes that modulate the chromatin structure or methylation patterns of the target and prevent transcription of the target gene, with the nucleotide sequence of the target thereby mediating silencing. More specifically, the target is any of HBV RNA, DNA, or mRNA.

In one aspect, the invention provides short interfering nucleic acid (siNA) molecules for inhibiting the expression of the HBV gene in a cell or mammal. The siNA can be single-stranded or double-stranded. When double-stranded, the siNA comprising a sense and an antisense stand. The antisense strand is complementary to at least a part of an mRNA formed in the expression of the HBV gene. The sense strand comprises a region that is complementary to the antisense strand. In specific embodiments, the antisense strand comprises at least a 15 nucleotide sequence of an antisense sequence listed in Table 1b. Generally, the double-stranded siNA comprises at least a 15 nucleotide sequence of the sense strand in Table 1b and at least a 15 nucleotide sequence of the antisense strand in Table 1b. One or more of the nucleotides of the siNAs of the invention are optionally modified. In further embodiments having modifications, some siNAs of the invention comprises at least one nucleotide sequence selected from the groups of sequences provide in Table 1c. In other embodiments, the siNA comprises at least two sequences selected from the group of sequences provided in Table 1c, wherein one of the at least two sequences is complementary to another of the at least two sequences and one of the at least two sequences is complementary to a sequence of a mRNA generated in the expression of the HBV gene. Examples of certain modified siNAs of the invention are in Table 1c.

The double stranded RNA molecules of the invention can comprise two distinct and separate strands that can be symmetric or asymmetric and are complementary, i.e., two single-stranded RNA molecules, or can comprise one single-stranded molecule in which two complementary portions, e.g., a sense region and an antisense region, are base-paired, and are covalently linked by one or more single-stranded "hairpin" areas (i.e. loops) resulting in, for example, a single-stranded short-hairpin polynucleotide or a circular single-stranded polynucleotide.

The linker can be polynucleotide linker or a non-nucleotide linker. In some embodiments, the linker is a non-nucleotide linker. In some embodiments, a hairpin or circular siNA molecule of the invention contains one or more loop motifs, wherein at least one of the loop portions of the siNA molecule is biodegradable. For example, a single-stranded hairpin siNA molecule of the invention is designed such that degradation of the loop portion of the siNA molecule in vivo can generate a double-stranded siNA with 3'-terminal overhangs, such as 3'-terminal nucleotide overhangs comprising 1, 2, 3 or 4 nucleotides. Or alternatively, a circular siNA molecule of the invention is designed such that degradation of the loop portions of the siNA molecule in vivo can generate a double-stranded siNA molecule with 3'-terminal overhangs, such as 3'-terminal nucleotide overhangs comprising about 2 nucleotides.

In symmetric siNA molecules of the invention, each strand, the sense (passenger) strand and antisense (guide) strand, are independently about 15 to about 30 (e.g., about 15, 16, 17, 18, 19, 20, 21, 22, 23, 24, 25, 26, 27, 28, 29, or 30) nucleotides in length. Generally, each strand of the symmetric siNA molecules of the invention are about 19-24 (e.g., about 19, 20, 21, 22, 23 or 24) nucleotides in length.

In asymmetric siNA molecules, the antisense region or strand of the molecule is about 15 to about 30 (e.g., about 15, 16, 17, 18, 19, 20, 21, 22, 23, 24, 25, 26, 27, 28, 29, or 30) nucleotides in length, wherein the sense region is about 3 to about 25 (e.g., about 3, 4, 5, 6, 7, 8, 9, 10, 11, 12, 13, 14, 15, 16, 17, 18, 19, 20, 21, 22, 23, 24, or 25) nucleotides in length. Generally, each strand of the asymmetric siNA molecules of the invention is about 19-24 (e.g., about 19, 20, 21, 22, 23 or 24) nucleotides in length.

In yet other embodiments, siNA molecules of the invention comprise single stranded hairpin siNA molecules, wherein the siNA molecules are about 25 to about 70 (e.g., about 25, 26, 27, 28, 29, 30, 31, 32, 33, 34, 35, 36, 40, 45, 50, 55, 60, 65, or 70) nucleotides in length.

In still other embodiments, siNA molecules of the invention comprise single-stranded circular siNA molecules, wherein the siNA molecules are about 38 to about 70 (e.g., about 38, 40, 45, 50, 55, 60, 65, or 70) nucleotides in length.

In still other embodiments, siNA molecules of the invention comprise single-stranded non-circular siNA molecules, wherein the siNA molecules are independently about 15 to about 30 (e.g., about 15, 16, 17, 18, 19, 20, 21, 22, 23, 24, 25, 26, 27, 28, 29, or 30) nucleotides in length.

In various symmetric embodiments, the siNA duplexes of the invention independently comprise about 15 to about 30 (e.g., about 15, 16, 17, 18, 19, 20, 21, 22, 23, 24, 25, 26, 27, 28, 29, or 30) base pairs. Generally, the duplex structure of siNAs of the invention is between 15 and 30, more generally between 18 and 25, yet more generally between 19 and 24, and most generally between 19 and 21 base pairs in length.

In yet other embodiments, where the duplex siNA molecules of the invention are asymmetric, the siNA molecules comprise about 3 to 25 (e.g., about 3, 4, 5, 6, 7, 8, 9, 10, 11, 12, 13, 14, 15, 16, 17, 18, 19, 20, 21, 22, 23, 24, or 25) base pairs. Generally, the duplex structure of siNAs of the invention is between 15 and 25, more generally between 18 and 25, yet more generally between 19 and 24, and most generally between 19 and 21 base pairs in length.

In still other embodiments, where the siNA molecules of the invention are hairpin or circular structures, the siNA molecules comprise about 15 to about 30 (e.g., about 15, 16, 17, 18, 19, 20, 21, 22, 23, 24, 25, 26, 27, 28, 29, or 30) base pairs.

The sense strand and antisense strand, or the sense region and antisense region, of the siNA molecules of the invention can be complementary. Also, the antisense strand or antisense region can be complementary to a nucleotide sequence or a portion thereof of the HBV target RNA. The sense strand or sense region of the siNA can comprise a nucleotide sequence of a HBV gene or a portion thereof. In certain embodiments, the sense region or sense strand of an siNA molecule of the invention is complementary to that portion of the antisense region or antisense strand of the siNA molecule that is complementary to a HBV target polynucleotide sequence, such as for example, but not limited to, those sequences represented by GENBANK Accession Nos. shown in Table 7.

In some embodiments, siNA molecules of the invention have perfect complementarity between the sense strand or sense region and the antisense strand or antisense region of the siNA molecule. In other or the same embodiments, the antisense strand of the siNA molecules of the invention are perfectly complementary to a corresponding target nucleic acid molecule.

In yet other embodiments, siNA molecules of the invention have partial complementarity (i.e., less than 100% complementarity) between the sense strand or sense region and the antisense strand or antisense region of the siNA molecule or between the antisense strand or antisense region of the siNA molecule and a corresponding target nucleic acid molecule. Thus, in some embodiments, the double-stranded nucleic acid molecules of the invention, have between about 15 to about 30 (e.g., about 15, 16, 17, 18, 19, 20, 21, 22, 23, 24, 25, 26, 27, 28, 29, or 30) nucleotides in one strand that are complementary to the nucleotides of the other strand. In other embodiments, the molecules have between about 15 to about 30 (e.g., about 15, 16, 17, 18, 19, 20, 21, 22, 23, 24, 25, 26, 27, 28, 29, or 30) nucleotides in the sense region that are complementary to the nucleotides of the antisense region. of the double-stranded nucleic acid molecule. In certain embodiments, the double-stranded nucleic acid molecules of the invention have between about 15 to about 30 (e.g., about 15, 16, 17, 18, 19, 20, 21, 22, 23, 24, 25, 26, 27, 28, 29, or 30) nucleotides in the antisense strand that are complementary to a nucleotide sequence of its corresponding target nucleic acid molecule.

In other embodiments, the siNA molecule can contain one or more nucleotide deletions, substitutions, mismatches and/or additions; provided, however, that the siNA molecule maintains its activity, for example, to mediate RNAi. In a non-limiting example, the deletion, substitution, mismatch and/or addition can result in a loop or bulge, or alternately a wobble or other alternative (non Watson-Crick) base pair. Thus, in some embodiments, for example, the double-stranded nucleic acid molecules of the invention, have 1 or more (e.g., 1, 2, 3, 4, 5, or 6) nucleotides, in one strand or region that are mismatches or non-base-paired with the other strand or region. In other embodiments, the double-stranded nucleic acid molecules of the invention, have 1 or more (e.g., 1, 2, 3, 4, 5, or 6) nucleotides in each strand or region that are mismatches or non-base-paired with the other strand or region. In a preferred embodiment, the siNA of the invention contains no more than 3 mismatches. If the antisense strand of the siNA contains mismatches to a target sequence, it is preferable that the area of mismatch not be located in the center of the region of complementarity.

In other embodiments, the siNA molecule can contain one or more nucleotide deletions, substitutions, mismatches and/or additions to a sequence in Table 1b provided, however, that the siNA molecule maintains its activity, for example, to mediate RNAi. In a non-limiting example, the deletion, substitution, mismatch and/or addition can result in a loop or bulge, or alternately a wobble or other alternative (non Watson-Crick) base pair.

The invention also comprises double-stranded nucleic acid (siNA) molecules as otherwise described hereinabove in which the first strand and second strand are complementary to each other and wherein at least one strand is hybridisable to the polynucleotide sequence of a sequence in Table 1b under conditions of high stringency, and wherein any of the nucleotides is unmodified or chemically modified.

Hybridization techniques are well known to the skilled artisan (see for instance, Sambrook et al., Molecular Cloning: A Laboratory Manual, 2nd Ed., Cold Spring Harbor Laboratory Press, Cold Spring Harbor, N.Y. (1989)). Preferred stringent hybridization conditions include overnight incubation at 42° C. in a solution comprising: 50% formamide, 5×SSC (150 mM NaCl, 15 mM trisodium citrate), 50 mM sodium phosphate (pH 7.6), 5×Denhardt's solution, 10% dextran sulfate, and 20 microgram/ml denatured, sheared salmon sperm DNA; followed by washing the filters in 0.1×SSC at about 65° C.

In one specific embodiment, the first strand has about 15, 16, 17, 18, 19, 20 or 21 nucleotides that are complementary to the nucleotides of the other strand and at least one strand is hybridisable to a polynucleotide sequence in Table 1b. In a more preferred embodiment, the first strand has about 15, 16, 17, 18, 19, 20 or 21 nucleotides that are complementary to the nucleotides of the other strand and at least one strand is hybridisable to SEQ ID NO: 1, SEQ ID NO: 1210, SEQ ID NO: 2, SEQ ID NO: 1211, SEQ ID NO: 3, SEQ ID NO: 1212, SEQ ID NO: 4, or SEQ ID NO:1213; under conditions of high stringency, and wherein any of the nucleotides is unmodified or chemically modified.

In certain embodiments, the siNA molecules of the invention comprise overhangs of about 1 to about 4 (e.g., about 1, 2, 3 or 4) nucleotides. The nucleotides in the overhangs can be the same or different nucleotides. In some embodiments, the overhangs occur at the 3'-end at one or both strands of the double-stranded nucleic acid molecule. For example, a double-stranded nucleic acid molecule of the invention can comprise a nucleotide or non-nucleotide overhang at the 3'-end of the antisense strand/region, the 3'-end of the sense strand/region, or both the antisense strand/region and the sense strand/region of the double-stranded nucleic acid molecule.

In some embodiments, the nucleotides comprising the overhang portion of an siNA molecule of the invention comprise sequences based on the HBV target polynucleotide sequence in which nucleotides comprising the overhang portion of the antisense strand/region of an siNA molecule of the invention can be complementary to nucleotides in the HBV target polynucleotide sequence and/or nucleotides comprising the overhang portion of the sense strand/region of an siNA molecule of the invention can comprise the nucleotides in the HBV target polynucleotide sequence. Thus, in some embodiments, the overhang comprises a two nucleotide overhang that is complementary to a portion of the HBV target polynucleotide sequence. In other embodiments, however, the overhang comprises a two nucleotide overhang that is not complementary to a portion of the HBV target polynucleotide sequence. In certain embodiments, the overhang comprises a 3'-UU overhang that is not complementary to a portion of the HBV target polynucleotide sequence. In other embodiments, the overhang comprises a UU overhang at the 3' end of the antisense strand and a TT overhang at the 3' end of the sense strand. In other embodiments, the overhang comprises nucleotides as described in the examples, Tables, and Figures herein.

In any of the embodiments of the siNA molecules described herein having 3'-terminal nucleotide overhangs, the overhangs are optionally chemically modified at one or more nucleic acid sugar, base, or backbone positions. Representative, but not limiting examples of modified nucleotides in the overhang portion of a double-stranded nucleic acid (siNA) molecule of the invention include: 2'-O-alkyl (e.g., 2'-O-methyl), 2'-deoxy, 2'-deoxy-2'-fluoro, 2'-deoxy-2'-fluoroarabino (FANA), 4'-thio, 2'-O-trifluoromethyl, 2'-O-ethyl-trifluoromethoxy, 2'-O-difluoromethoxy-ethoxy, universal base, acyclic, or 5-C-methyl nucleotides. In more preferred embodiments, the overhang nucleotides are each independently, a 2'-O-alkyl nucleotide, a 2'-O-methyl nucleotide, a 2'-dexoy-2-fluoro nucleotide, or a 2'-deoxy ribonucleotide. In some instances the overhang nucleotides are linked by a one or more phosphorothioate linkages.

In yet other embodiments, siNA molecules of the invention comprise duplex nucleic acid molecules with blunt ends (i.e., without nucleotide overhangs), where both ends are blunt, or alternatively, where one of the ends is blunt. In some embodiments, the siNA molecules of the invention can comprises one blunt end, for example wherein the 5'-end of the antisense strand and the 3'-end of the sense strand do not have any overhanging nucleotides. In another example, the siNA molecule comprises one blunt end, for example wherein the 3'-end of the antisense strand and the 5'-end of the sense strand do not have any overhanging nucleotides. In other embodiments, siNA molecules of the invention comprise two blunt ends, for example wherein the 3'-end of the antisense strand and the 5'-end of the sense strand as well as the 5'-end of the antisense strand and 3'-end of the sense strand do not have any overhanging nucleotides.

In any of the embodiments or aspects of the siNA molecules of the invention, the sense strand and/or the antisense strand can further have a cap, such as described herein or as known in the art, at the 3'-end, the 5'-end, or both of the 3' and 5'-ends of the sense strand and/or antisense strand. Or as in the case of a hairpin siNA molecule, the cap can be at either one or both of the terminal nucleotides of the polynucleotide. In some embodiments, the cap is at one of both of the ends of the sense strand of a double-stranded siNA molecule. In other embodiments, the cap is at the 3'-end of antisense (guide) strand. In preferred embodiments, the caps are at the 3'-end of the sense strand and the 5'-end of the sense strand.

Representative, but non-limiting examples of such terminal caps include an inverted abasic nucleotide, an inverted deoxy abasic nucleotide, an inverted nucleotide moiety, a group shown in FIG. 5, a glyceryl modification, an alkyl or cycloalkyl group, a heterocycle, or any other cap as is generally known in the art.

Any of the embodiments of the siNA molecules of the invention can have a 5' phosphate termini. In some embodiments, the siNA molecules lack terminal phosphates.

Any siNA molecule or construct of the invention can comprise one or more chemical modifications. Modifications can be used to improve in vitro or in vivo characteristics such as stability, activity, toxicity, immune response (e.g., prevent stimulation of an interferon response, an inflammatory or pro-inflammatory cytokine response, or a Toll-like Receptor (TIF) response), and/or bioavailability.

Applicants describe herein chemically modified siNA molecules with improved RNAi activity and/or stability compared to corresponding unmodified siNA molecules. Various chemically modified siNA motifs disclosed herein provide the capacity to maintain RNAi activity that is substantially similar to unmodified or minimally modified active siRNA (see for example Elbashir et al., 2001, EMBO J., 20:6877-6888) while at the same time providing nuclease resistance and pharmacokinetic properties suitable for use in therapeutic applications.

In various embodiments, the siNA molecules of the invention comprise modifications wherein any (e.g., one or more or all) nucleotides present in the sense and/or antisense strand are modified nucleotides (e.g., wherein one nucleotide is modified, some nucleotides (i.e., plurality or more than one) are modified, or all nucleotides are modified nucleotides. In some embodiments, the siNA molecules of the invention are partially modified (e.g., about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, or 59 nucleotides are modified) with chemical modifications. In some embodiments, an siNA molecule of the invention comprises at least about 8, 10, 12, 14, 16, 18, 20, 22, 24, 26, 28, 30, 32, 34, 36, 38, 40, 42, 44, 46, 48, 50, 52, 54, 56, 58, or 60 nucleotides that are modified nucleotides. In other embodiments, the siNA molecules of the invention are completely modified (e.g., 100% modified) with chemical modifications, i.e., the siNA molecule does not contain any ribonucleotides. In some of embodiments, one or more of the nucleotides in the sense strand of the siNA molecules of the invention are modified. In the same or other embodiments, one or more of the nucleotides in the antisense strand of the siNA molecules of the invention are modified.

The chemical modification within a single siNA molecule can be the same or different. In some embodiments, at least one strand has at least one chemical modification. In other embodiments, each strand has at least one chemical modifications, which can be the same or different, such as, sugar, base, or backbone (i.e., internucleotide linkage) modifications. In other embodiments, siNA molecules of the invention contain at least 2, 3, 4, 5, or more different chemical modifications.

Non-limiting examples of chemical modifications that are suitable for use in the present invention, are disclosed in U.S. patent application Ser. Nos. 10/444,853; 10/981,966; 12/064, 014 and in references cited therein and include sugar, base, and phosphate, non-nucleotide modifications, and/or any combination thereof.

In certain specific embodiments of the invention, at least one modified nucleotide is a 2'-deoxy-2-fluoro nucleotide, a 2'-deoxy nucleotide, a 2'-O-alkyl (e.g., 2'-O-methyl) nucleotide, or a locked nucleic acid (LNA) nucleotide as is generally recognized in the art.

In yet other embodiment of the invention, at least one nucleotide has a ribo-like, Northern or A form helix configuration (see e.g., Saenger, Principles of Nucleic Acid Structure, Springer-Verlag ed., 1984). Non-limiting examples of nucleotides having a Northern configuration include locked nucleic acid (LNA) nucleotides (e.g., 2'-O, 4'-C-methylene-(D-ribofuranosyl)nucleotides); 2'-methoxyethoxy (MOE)

nucleotides; 2'-methyl-thio-ethyl nucleotides, 2'-deoxy-2'-fluoro nucleotides; 2'-deoxy-2'-chloro nucleotides; 2'-azido nucleotides; 2'-O-trifluoromethyl nucleotides; 2'-O-ethyl-trifluoromethoxy nucleotides; 2'-O-difluoromethoxy-ethoxy nucleotides; 4'-thio nucleotides and 2'-O-methyl nucleotides.

In various embodiments, a majority (e.g., greater than 50%) of the pyrimidine nucleotides present in the double-stranded siNA molecule comprises a sugar modification. In some of the same and/or other embodiments, a majority (e.g., greater than 50%) of the purine nucleotides present in the double-stranded siNA molecule comprises a sugar modification.

In some embodiments, the pyrimidine nucleotides in the antisense strand are 2'-O-methyl or 2'-deoxy-2'-fluoro pyrimidine nucleotides and the purine nucleotides present in the antisense strand are 2'-O-methyl nucleotides or 2'-deoxy nucleotides. In other embodiments, the pyrimidine nucleotides in the sense strand are 2'-deoxy-2'-fluoro pyrimidine nucleotides and the purine nucleotides present in the sense strand are 2'-O-methyl or 2'-deoxy purine nucleotides.

In certain embodiments of the invention, all the pyrimidine nucleotides in the complementary region on the sense strand are 2'-deoxy-2'-fluoro pyrimidine nucleotides. In certain embodiments, all of the pyrimidine nucleotides in the complementary region of the antisense strand are 2'-deoxy-2'-fluoro pyrimidine nucleotides. In certain embodiments, all the purine nucleotides in the complementary region on the sense strand are 2'-deoxy purine nucleotides. In certain embodiments, all of the purines in the complementary region on the antisense strand are 2'-O-methyl purine nucleotides. In certain embodiments, all of the pyrimidine nucleotides in the complementary regions on the sense strand are 2'-deoxy-2'-fluoro pyrimidine nucleotides; all of the pyrimidine nucleotides in the complementary region of the antisense strand are 2'-deoxy-2'-fluoro pyrimidine nucleotides; all the purine nucleotides in the complementary region on the sense strand are 2'-deoxy purine nucleotides and all of the purines in the complementary region on the antisense strand are 2'-O-methyl purine nucleotides.

In some embodiments, at least 5 or more of the pyrimidine nucleotides in one or both stands are 2'-deoxy-2'-fluoro pyrimidine nucleotides. In some embodiments, at least 5 or more of the pyrimidine nucleotides in one or both stands are 2'-O-methylpyrimidine nucleotides. In some embodiments, at least 5 or more of the purine nucleotides in one or both stands are 2'-deoxy-2'-fluoro purine nucleotides In some embodiments, at least 5 or more of the purine nucleotides in one or both stands are 2'-O-methyl purine nucleotides.

In certain embodiments, the purines and pyrimidines are differentially modified at the 2'-sugar position (i.e., at least one purine has a different modification from at least one pyrimidine in the same or different strand at the 2'-sugar position). For example, in some instances, at least 5 or more of the pyrimidine nucleotides in one or both stands are 2'-deoxy-2'-fluoro pyrimidine nucleotides and at least 5 or more purine nucleotides in one or both strands are 2'-O-methyl purine nucleotides. In other instances at least 5 or more of the pyrimidine nucleotides in one or both stands are 2'-O-methylpyrimidine nucleotides and at least 5 or more purine nucleotides in one or both strands are 2'-deoxy-2'-fluoro purine nucleotides.

Figure 1:
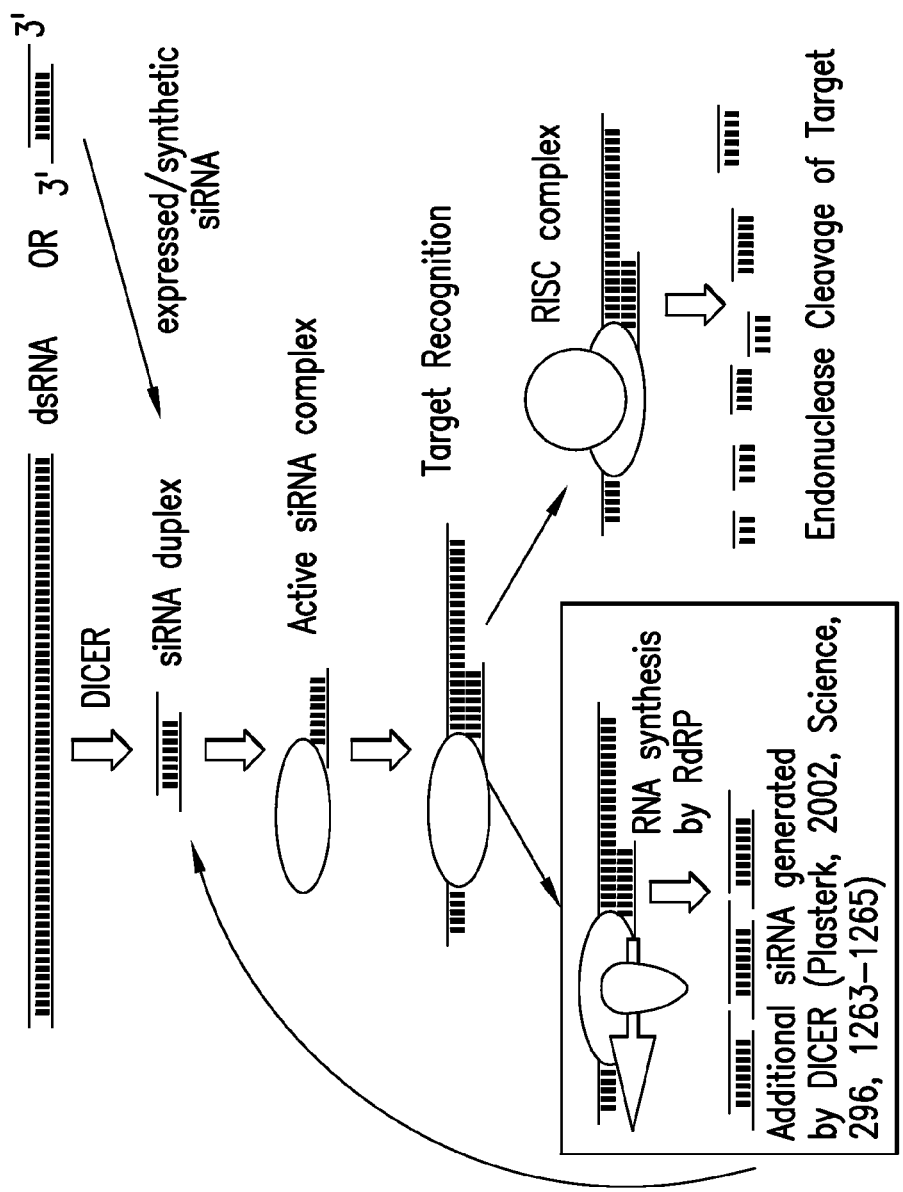
FIG. 1 shows a non-limiting proposed mechanistic representation of target RNA degradation involved in RNAi. Double-stranded RNA (dsRNA), which is generated by RNA-dependent RNA polymerase (RdRP) from foreign single-stranded RNA, for example viral, transposon, or other exogenous RNA, activates the DICER enzyme that in turn generates siNA duplexes. Alternately, synthetic or expressed siNA can be introduced directly into a cell by appropriate means. An active siNA complex forms that recognizes a target RNA, resulting in degradation of the target RNA by the RISC endonuclease complex or in the synthesis of additional RNA by RNA-dependent RNA polymerase (RdRP), which can activate DICER and result in additional siNA molecules, thereby amplifying the RNAi response.
Figure 2:
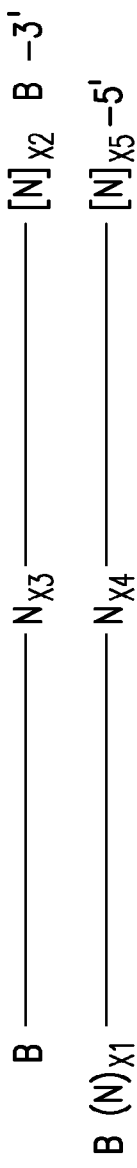
FIG. 2 shows non-limiting examples of chemically modified siNA constructs of the present invention using a generalized structure of a representative siNA duplex. The specific modifications shown in the figure can be utilized alone or in combination with other modifications of the figure, in addition to other modifications and features described herein with reference to any siNA molecule of the invention. In the figure, N stands for any nucleotide or optionally a non-nucleotide as described here. The upper strand, having B—$N_{X3}$—$(N)_{X2}$—B-3' is the sense (or passenger) strand of the siNA, whereas the lower strand, having $B(N)_{X1}$—$N_{X4}$—$[N]_{X5}$-5' is the antisense (or guide) strand of the siNA. Nucleotides (or optional non-nucleotides) of internal portions of the sense strand are designated $N_{X3}$ and nucleotides (or optional non-nucleotides) of internal portions of the antisense strand are designated $N_{X4}$. Nucleotides (or optional non-nucleotides) of the internal portions are generally base paired between the two strands, but can optionally lack base pairing (e.g. have mismatches or gaps) in some embodiments. Nucleotides (or optional non-nucleotides) of overhang regions are designated by parenthesis (N). Nucleotides of the 5'-terminal portion of the antisense strand are designated [N]. Terminal caps are optionally present at the 5' and/or 3' end of the sense strand and further optionally present at the 3'-end of the antisense strand. Generally, each strand can independently range from about 15 to about 30 nucleotides in length, but can vary depending on the presence of any overhang nucleotides. In certain embodiments, X1 and X2 are independently integers from 0 to 4; X3 is an integer from 15 to 30; X4 is an integer from 9 to 30; X5 is an integer from 0 to 6, provided that the sum of X4 and X5 is 15-30. Various modifications are shown for the nucleotides of the sense and antisense strands of the siNA constructs. The (N) overhang nucleotide positions can be chemically modified as described herein (e.g., 2'-O-methyl, 2'-deoxy-2'-fluoro, 2'-deoxy, LNA, universal bases etc.) and can be either derived from a corresponding target nucleic acid sequence or not. The constructs shown in the figure can also comprise phosphorothioate linkages as described herein. For example, phosphorothioate linkages can exist between any N, (N), and/or [N] positions. Such phosphorothioate incorporation can be utilized between purine "R" and pyrimidine "Y" positions, or for stabilization of pyrimidine linkages in general. Furthermore, although not depicted on the Figure, the constructs shown in the figure can optionally include a ribonucleotide at the $9^{th}$ position from the 5'-end of the sense strand or the $11^{th}$ position based on the 5'-end of the guide strand by counting 11 nucleotide positions in from the 5'-terminus of the guide strand. Similarly, the antisense strand can include a ribonucleotide at the $14^{th}$ position from the 5'-end, or alternately can be selected or designed so that a 2'-O-alkyl nucleotide (e.g., a 2'-O-methyl purine) is not present at this position. Furthermore, although not shown in the Figure, the 5'-terminal position of the antisense strand can comprise a terminal phosphate group as described herein. The antisense strand generally comprises sequence complementary to any target nucleic acid sequence of the invention, such as those set forth in Table 1a herein.

Further non-limiting examples of sense and antisense strands of such siNA molecules having various modifications and modifications patterns are shown in FIGS. 2 and 3.

Any of the above described modifications, or combinations thereof, including those in the references cited, can be applied to any of the siNA molecules of the invention.

The modified siNA molecules of the invention can comprise modifications at various locations within the siNA molecule. In some embodiments, the double-stranded siNA molecule of the invention comprises modified nucleotides at internal base paired positions within the siNA duplex. In other embodiments, a double-stranded siNA molecule of the invention comprises modified nucleotides at non-base paired or overhang regions of the siNA molecule. In yet other embodiments, a double-stranded siNA molecule of the invention comprises modified nucleotides at terminal positions of the siNA molecule. For example, such terminal regions include the 3'-position and/or 5'-position of the sense and/or antisense strand or region of the siNA molecule. Additionally, any of the modified siNA molecules of the invention can have a modification in one or both oligonucleotide strands of the siNA duplex, for example in the sense strand, the antisense strand, or both strands. Moreover, with regard to chemical modifications of the siNA molecules of the invention, each strand of the double-stranded siNA molecules of the invention can have one or more chemical modifications, such that each strand comprises a different pattern of chemical modifications.

In certain embodiments each strand of a double-stranded siNA molecule of the invention comprises a different pattern of chemical modifications, such as any Stab modification chemistries described herein (see Table 8) or any combination thereof, i.e., different combinations of defined Stabilzation chemistry (Stab) sense and antisense strands. Further, non-limiting examples of modification schemes that could give rise to different patterns of modifications are shown in Table 8. The stabilization chemistries referred to in Table 8 as Stab, can be combined in any combination of sense/antisense chemistries, such as Stab 7/8, Stab 7/11, Stab 8/8, Stab 18/8, Stab 18/11, Stab 12/13, Stab 7/13, Stab 18/13, Stab 7/19, Stab 8/19, Stab 18/19, Stab 7/20, Stab 8/20, Stab 18/20, Stab 7/32, Stab 8/32, or Stab 18/32 or any other combination of Stabilization chemistries.

In any of the siNAs of the invention, one or more (for example 1, 2, 3, 4 or 5) nucleotides at the 5'-end of the guide strand or guide region (also known as antisense strand or antisense region) of the siNA molecule are ribonucleotides.

In certain embodiments, the present invention provides a double-stranded short interfering nucleic acid (siNA) molecule that modulates the expression of HBV, wherein the siNA comprises a sense strand and an antisense strand; each strand is independently 15 to 30 nucleotides in length; and the antisense strand comprises at least 15 nucleotides having sequence complementary to any of:

```
5'- UCGUGGUGGACUUCUCUCA-3';      (SEQ ID NO: 1)

5'- GUGGUGGACUUCUCUCAAU-3';      (SEQ ID NO: 2)

5'- GCCGAUCCAUACUGCGGAA-3';      (SEQ ID NO: 3)
or

5'- CCGAUCCAUACUGCGGAAC-3'.      (SEQ ID NO: 4)
```

In some embodiments, the antisense strand of a siNA molecule of the invention comprises at least a 15 nucleotide sequence of:

```
5'-UGAGAGAAGUCCACCACGA-3';      (SEQ ID NO: 452)

5'-AUUGAGAGAAGUCCACCAC-3';      (SEQ ID NO: 453)
```

```
5'-UUCCGCAGUAUGGAUCGGC-3';    (SEQ ID NO: 454)
or
5'-GUUCCGCAGUAUGGAUCGG-3'.    (SEQ ID NO: 455)
```

In some embodiments, the sense strand of a siNA molecule of the invention comprises at least a 15 nucleotide sequence of:

```
5'- UCGUGGUGGACUUCUCUCA-3';    (SEQ ID NO: 1)

5'- GUGGUGGACUUCUCUCAAU-3';    (SEQ ID NO: 2)

5'- GCCGAUCCAUACUGCGGAA-3';    (SEQ ID NO: 3)
or

5'- CCGAUCCAUACUGCGGAAC-3'.    (SEQ ID NO: 4)
```

In some embodiments, a siNA molecule of the invention comprises any of:

```
5'-UCGUGGUGGACUUCUCUCA-3'      (SEQ ID NO: 1)
and
5'-UGAGAGAAGUCCACCACGA-3';     (SEQ ID NO: 452)
or
5'-GUGGUGGACUUCUCUCAAU-3';     (SEQ ID NO: 2)
and
5'-AUUGAGAGAAGUCCACCAC-3';     (SEQ ID NO: 453)
or
5'-GCCGAUCCAUACUGCGGAA-3'      (SEQ ID NO: 3)
and
5'-UUCCGCAGUAUGGAUCGGC-3';     (SEQ ID NO: 454)
or
5'-CCGAUCCAUACUGCGGAAC-3';     (SEQ ID NO: 4)
and
5'-GUUCCGCAGUAUGGAUCGG-3'.     (SEQ ID NO: 455)
```

Any of the above described modifications, or combinations thereof, including those in the references cited, can be applied to any of these embodiments.

In certain embodiments, the nucleotides of the at least a 15 nucleotide sequence of SEQ ID NO: 1, SEQ ID NO: 452, SEQ ID NO: 2, SEQ ID NO: 453, SEQ ID NO: 3, SEQ ID NO: 454, SEQ ID NO: 4, or SEQ ID NO:455 form a contiguous stretch of nucleotides.

In some embodiments, the siNA molecule can contain one or more nucleotide deletions, substitutions, mismatches and/or additions to the at least 15 nucleotide sequence of SEQ ID NO: 1, SEQ ID NO: 452, SEQ ID NO: 2, SEQ ID NO: 453, SEQ ID NO: 3, SEQ ID NO: 454, SEQ ID NO: 4, or SEQ ID NO:455; provided, however, that the siNA molecule maintains its activity, for example, to mediate RNAi. In a non-limiting example, the deletion, substitution, mismatch and/or addition can result in a loop or bulge, or alternately a wobble or other alternative (non Watson-Crick) base pair.

In certain embodiments of the invention, double-stranded siNA molecules are provided, wherein the molecule has a sense strand and an antisense strand and comprises the following formula (A):

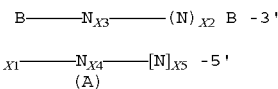

wherein, the upper strand is the sense strand and the lower strand is the antisense strand of the double-stranded nucleic acid molecule; wherein the antisense strand comprises at least a 15 nucleotide sequence of SEQ ID NO: 452, SEQ ID NO: 453, SEQ ID NO: 454, or SEQ ID NO: 455, and the sense strand comprises a sequence having complementarity to the antisense strand;

each N is independently a nucleotide which is unmodified or chemically modified or a non-nucleotide;

each B is a terminal cap that is present or absent;

(N) represents overhanging nucleotides, each of which is independently unmodified or chemically modified;

[N] represents nucleotides that are ribonucleotides;

X1 and X2 are independently integers from 0 to 4;

X3 is an integer from 15 to 30;

X4 is an integer from 9 to 30; and

X5 is an integer from 0 to 6, provided that the sum of X4 and X5 is 15-30.

In certain embodiments, the nucleotides of the at least a 15 nucleotide sequence of SEQ ID NO: 452, SEQ ID NO: 453, SEQ ID NO: 454, or SEQ ID NO: 455 form a contiguous stretch of nucleotides.

In some embodiments, the siNA molecule of formula A can contain one or more nucleotide deletions, substitutions, mismatches and/or additions to the at least 15 nucleotide sequence of SEQ ID NO: 452, SEQ ID NO: 453, SEQ ID NO: 454, or SEQ ID NO: 455; provided, however, that the siNA molecule maintains its activity, for example, to mediate RNAi. In a non-limiting example, the deletion, substitution, mismatch and/or addition can result in a loop or bulge, or alternately a wobble or other alternative (non Watson-Crick) base pair.

In one embodiment, the invention features a double-stranded short interfering nucleic acid (siNA) of formula (A); wherein (a) one or more pyrimidine nucleotides in $N_{X4}$ positions are independently 2'-deoxy-2'-fluoro nucleotides, 2'-O-alkyl nucleotides, 2'-deoxy nucleotides, ribonucleotides, or any combination thereof;

(b) one or more purine nucleotides in $N_{X4}$ positions are independently 2'-deoxy-2'-fluoro nucleotides, 2'-O-alkyl nucleotides, 2'-deoxy nucleotides, ribonucleotides, or any combination thereof;

(c) one or more pyrimidine nucleotides in $N_{X3}$ positions are independently 2'-deoxy-2'-fluoro nucleotides, 2'-O-alkyl nucleotides, 2'-deoxy nucleotides, ribonucleotides, or any combination thereof; and (d) one or more purine nucleotides in $N_{X3}$ positions are independently 2'-deoxy-2'-fluoro nucleotides, 2'-O-alkyl nucleotides, 2'-deoxy nucleotides, ribonucleotides, or any combination thereof.

In certain embodiments, the invention features a double-stranded short interfering nucleic acid (siNA) molecule of formula (A); wherein (a) 1, 2, 3, 4, 5 or more pyrimidine nucleotides in $N_{X4}$ positions are 2'-deoxy-2'-fluoro nucleotides;

(b) 1, 2, 3, 4, 5 or more purine nucleotides in $N_{X4}$ positions are 2'-O-alkyl nucleotides;

(c) 1, 2, 3, 4, 5 or more pyrimidine nucleotides in $N_{X3}$ positions are 2'-deoxy-2'-fluoro nucleotides; and (d) 1, 2, 3, 4, 5 or more purine nucleotides in $N_{X3}$ positions are 2'-deoxy nucleotides.

In certain embodiments, the invention features a double-stranded short interfering nucleic acid (siNA) molecule of formula (A); wherein
(a) 1, 2, 3, 4, 5 or more pyrimidine nucleotides in $N_{X4}$ positions are 2'-O-alkyl nucleotides;
(b) 1, 2, 3, 4, 5 or more purine nucleotides in $N_{X4}$ positions are ribonucleotides;
(c) 1, 2, 3, 4, 5 or more pyrimidine nucleotides in $N_{X3}$ positions are 2'-O-alkyl nucleotides; and
(d) 1, 2, 3, 4, 5 or more purine nucleotides in $N_{X3}$ positions are ribonucleotides.

In certain embodiments, the invention features a double-stranded short interfering nucleic acid (siNA) molecule of formula (A); wherein
(a) 1, 2, 3, 4, 5 or more pyrimidine nucleotides in $N_{X4}$ positions are 2'-deoxy-2'-fluoro nucleotides;
(b) 1, 2, 3, 4, 5 or more purine nucleotides in $N_{X4}$ positions are 2'-O-alkyl nucleotides;
(c) 1, 2, 3, 4, 5 or more pyrimidine nucleotides in $N_{X3}$ positions are 2'-O-alkyl nucleotides; and
(d) 1, 2, 3, 4, 5 or more purine nucleotides in $N_{X3}$ positions are 2'-deoxy-2'-fluoro nucleotides.

In certain embodiments, the invention features a double-stranded short interfering nucleic acid (siNA) molecule of formula (A) further comprising one or more phosphorothioate internucleotide linkages.

In some embodiments, siNA molecules having formula A comprise a terminal phosphate group at the 5'-end of the antisense strand or antisense region of the nucleic acid molecule.

In various embodiments, siNA molecules having formula A comprise X5=0, 1, 2, or 3; each X1 and X2=1 or 2; X3=18, 19, 20, 21, 22, or 23, and X4=17, 18, 19, 20, 21, 22, or 23.

In certain embodiments, siNA molecules having formula A comprise X5=3. In other embodiments siNA molecules having formula A comprise X5=0.

In certain embodiments, siNA molecules having formula A comprise X1=2 and X2=2.

In various embodiments, siNA molecules having formula A comprise X5=0, X1=2, and X2=2. In other embodiments, siNA molecules having formula A comprise X5=3, X1=2, and X2=2.

In one specific embodiment, an siNA molecule having formula A comprises X5=3; each X1 and X2=2; X3=19, and X4=16.

In another specific embodiment, an siNA molecule having formula A comprises X5=0; each X1 and X2=2; X3=19, and X4=19.

In certain embodiments, siNA molecules having formula A comprise caps (B) at the 3' and 5' ends of the sense strand or sense region.

In certain embodiments, siNA molecules having formula A comprise caps (B) at the 3'-end of the antisense strand or antisense region.

In various embodiments, siNA molecules having formula A comprise caps (B) at the 3' and 5' ends of the sense strand or sense region and caps (B) at the 3'-end of the antisense strand or antisense region.

In yet other embodiments, siNA molecules having formula A comprise caps (B) only at the 5'-end of the sense (upper) strand of the double-stranded nucleic acid molecule.

In some embodiments, siNA molecules having formula A further comprise one or more phosphorothioate internucleotide linkages between the nucleotides. In certain embodiments, siNA molecules having formula A comprise one or more phosphorothioate internucleotide linkages between the first terminal (N) and the adjacent nucleotide on the 3' end of the sense strand, antisense strand, or both sense strand and antisense strands of the nucleic acid molecule. For example, a double-stranded nucleic acid molecule can comprise X1 and/or X2=2 having overhanging nucleotide positions with a phosphorothioate internucleotide linkage, e.g., (NsN) where "s" indicates phosphorothioate.

In some embodiments, one or more of the nucleotides of siNA molecules having formula A have a universal base.

In certain embodiments, siNA molecules having formula A have at position 14 from the 5'-end of the antisense strand a ribonucleotide when the nucleotide at that position 14 is a purine. In other embodiments, siNA molecules having formula A have at position 14 from the 5'-end of the antisense strand a ribonucleotide, a 2'-deoxy-2'-fluoro nucleotide or a 2'-O-methyl nucleotide when the nucleotide at that position 14 is a pyrimidine nucleotide.

In some embodiments, siNA molecules having formula A comprises (N) nucleotides in the antisense strand (lower strand) that are complementary to nucleotides in a HBV target polynucleotide sequence, which also has complementarity to the N and [N] nucleotides of the antisense (lower) strand.

Any of the above described modifications, or combinations thereof, discussed above as applicable to siNAs of the invention, including those in the references cited, can be applied to any of the embodiments to siNA molecules having formula A.

C. Generation/Synthesis of siNA Molecules

The siNAs of the invention can be obtained using a number of techniques known to those of skill in the art. For example the siNA can be chemically synthesized or may be encoded by plasmid (e.g., transcribed as sequences that automatically fold into duplexes with hairpin loops). siNA can also be generated by cleavage of longer dsRNA (e.g., dsRNA greater than about 25 nucleotides in length) by the *E coli* RNase II or Dicer. These enzymes process the dsRNA into biologically active siNA (see, e.g., Yang et al., PNAS USA 99:9942-9947 (2002); Calegari et al. *PNAS USA* 99:14236 (2002) Byron et al. Ambion Tech Notes; 10 (1):4-6 (2009); Kawaski et al., *Nucleic Acids Res.*, 31:981-987 (2003), Knight and Bass, *Science,* 293:2269-2271 (2001) and Roberston et al., *J. Biol. Chem.* 243:82 (1969).

1. Chemical Synthesis

Preferably, siNA of the invention are chemically synthesized. Oligonucleotides (e.g., certain modified oligonucleotides or portions of oligonucleotides lacking ribonucleotides) are synthesized using protocols known in the art, for example as described in Caruthers et al., 1992, *Methods in Enzymology* 211, 3-19, Thompson et al., International PCT Publication No. WO 99/54459, Wincott et al., 1995, *Nucleic Acids Res.* 23, 2677-2684, Wincott et al., 1997, *Methods Mol. Bio.,* 74, 59, Brennan et al., 1998, *Biotechnol Bioeng.,* 61, 33-45, and Brennan, U.S. Pat. No. 6,001,311. The synthesis of oligonucleotides makes use of common nucleic acid protecting and coupling groups, such as dimethoxytrityl at the 5'-end, and phosphoramidites at the 3'-end.

siNA molecules without modifications are synthesized using procedures as described in Usman et al., 1987, *J. Am. Chem. Soc.,* 109, 7845; Scaringe et al., 1990, *Nucleic Acids Res.,* 18, 5433. These syntheses makes use of common nucleic acid protecting and coupling groups, such as dimethoxytrityl at the 5'-end, and phosphoramidites at the 3'-end that can be used for certain siNA molecules of the invention.

In certain embodiments, the siNA molecules of the invention are synthesized, deprotected, and analyzed according to methods described in U.S. Pat. Nos. 6,995,259, 6,686,463, 6,673,918, 6,649,751, 6,989,442, and U.S. patent application Ser. No. 10/190,359.

In a non-limiting synthesis example, small scale syntheses are conducted on a 394 Applied Biosystems, Inc. synthesizer using a 0.2 µmol scale protocol with a 2.5 min coupling step for 2'-O-methylated nucleotides and a 45 second coupling step for 2'-deoxy nucleotides or 2'-deoxy-2'-fluoro nucleotides. Table 9 outlines the amounts and the contact times of the reagents used in the synthesis cycle.

Alternatively, the siNA molecules of the present invention can be synthesized separately and joined together post-synthetically, for example, by ligation (Moore et al., 1992, Science 256, 9923; Draper et al., International PCT Publication No. WO 93/23569; Shabarova et al., 1991, Nucleic Acids Research 19, 4247; Bellon et al., 1997, Nucleosides & Nucleotides, 16, 951; Bellon et al., 1997, Bioconjugate Chem. 8, 204), or by hybridization following synthesis and/or deprotection.

Various siNA molecules of the invention can also be synthesized using the teachings of Scaringe et al., U.S. Pat. Nos. 5,889,136; 6,008,400; and 6,111,086.

2. Vector Expression

Alternatively, siNA molecules of the invention that interact with and down-regulate gene encoding target HBV molecules can be expressed and delivered from transcription units (see for example Couture et al., 1996, TIG., 12, 510) inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus.

In some embodiments, pol III based constructs are used to express nucleic acid molecules of the invention. Transcription of the siNA molecule sequences can be driven from a promoter for eukaryotic RNA polymerase I (pol I), RNA polymerase II (pol II), or RNA polymerase III (pol III). (see for example, Thompson, U.S. Pat. Nos. 5,902,880 and 6,146,886). (See also, Izant and Weintraub, 1985, Science, 229, 345; McGarry and Lindquist, 1986, Proc. Natl. Acad. Sci., USA 83, 399; Scanlon et al., 1991, Proc. Natl. Acad. Sci. USA, 88, 10591-5; Kashani-Sabet et al., 1992, Antisense Res. Dev., 2, 3-15; Dropulic et al., 1992, J. Virol., 66, 1432-41; Weerasinghe et al., 1991, J. Virol., 65, 5531-4; Ojwang et al., 1992, Proc. Natl. Acad. Sci. USA, 89, 10802-6; Chen et al., 1992, Nucleic Acids Res., 20, 4581-9; Sarver et al., 1990 Science, 247, 1222-1225; Thompson et al., 1995, Nucleic Acids Res., 23, 2259; Good et al., 1997, Gene Therapy, 4, 45. Transcripts from pol II or pol III promoters are expressed at high levels in all cells; the levels of a given pol II promoter in a given cell type depends on the nature of the gene regulatory sequences (enhancers, silencers, etc.) present nearby. Prokaryotic RNA polymerase promoters are also used, providing that the prokaryotic RNA polymerase enzyme is expressed in the appropriate cells (Elroy-Stein and Moss, 1990, Proc. Natl. Acad. Sci. USA, 87, 6743-7; Gao and Huang 1993, Nucleic Acids Res., 21, 2867-72; Lieber et al., 1993, Methods Enzymol., 217, 47-66; Zhou et al., 1990, Mol. Cell. Biol., 10, 4529-37). Several investigators have demonstrated that nucleic acid molecules expressed from such promoters can function in mammalian cells (e.g. Kashani-Sabet et al., 1992, Antisense Res. Dev., 2, 3-15; Ojwang et al., 1992, Proc. Natl. Acad. Sci. USA, 89, 10802-6; Chen et al., 1992, Nucleic Acids Res., 20, 4581-9; Yu et al., 1993, Proc. Natl. Acad. Sci. USA, 90, 6340-4; L'Huillier et al., 1992, EMBO J., 11, 4411-8; Lisziewicz et al., 1993, Proc. Natl. Acad. Sci. U.S. A, 90, 8000-4; Thompson et al., 1995, Nucleic Acids Res., 23, 2259; Sullenger & Cech, 1993, Science, 262, 1566). More specifically, transcription units such as the ones derived from genes encoding U6 small nuclear (snRNA), transfer RNA (tRNA) and adenovirus VA RNA are useful in generating high concentrations of desired RNA molecules such as siNA in cells (Thompson et al., supra; Couture and Stinchcomb, 1996, supra; Noonberg et al., 1994, Nucleic Acid Res., 22, 2830; Noonberg et al., U.S. Pat. No. 5,624,803; Good et al., 1997, Gene Ther., 4, 45; Beigelman et al., International PCT Publication No. WO 96/18736. The above siNA transcription units can be incorporated into a variety of vectors for introduction into mammalian cells, including but not restricted to, plasmid DNA vectors, viral DNA vectors (such as adenovirus or adeno-associated virus vectors), or viral RNA vectors (such as retroviral or alphavirus vectors) (for a review see Couture and Stinchcomb, 1996, supra).

Vectors used to express the siNA molecules of the invention can encode one or both strands of an siNA duplex, or a single self-complementary strand that self hybridizes into an siNA duplex. The nucleic acid sequences encoding the siNA molecules of the instant invention can be operably linked in a manner that allows expression of the siNA molecule (see for example Paul et al., 2002, Nature Biotechnology, 19, 505; Miyagishi and Taira, 2002, Nature Biotechnology, 19, 497; Lee et al., 2002, Nature Biotechnology, 19, 500; and Novina et al., 2002, Nature Medicine, advance online publication doi:10.1038/nm725).

D. Carrier/Delivery Systems

The siNA molecules of the invention are added directly, or can be complexed with cationic lipids, packaged within liposomes, or as a recombinant plasmid or viral vectors which express the siNA molecules, or otherwise delivered to target cells or tissues. Methods for the delivery of nucleic acid molecules are described in Akhtar et al., 1992, Trends Cell Bio., 2, 139; Delivery Strategies for Antisense Oligonucleotide Therapeutics, ed. Akhtar, 1995, Maurer et al., 1999, Mol. Membr. Biol., 16, 129-140; Hofland and Huang, 1999, Handb. Exp. Pharmacol., 137, 165-192; and Lee et al., 2000, ACS Symp. Ser., 752, 184-192. Beigelman et al., U.S. Pat. No. 6,395,713 and Sullivan et al., PCT WO 94/02595 further describe the general methods for delivery of nucleic acid molecules. These protocols can be utilized for the delivery of virtually any nucleic acid molecule. Nucleic acid molecules can be administered to cells by a variety of methods known to those of skill in the art, including, but not restricted to, encapsulation in liposomes, by iontophoresis, or by incorporation into other vehicles, such as biodegradable polymers, hydrogels, cyclodextrins (see for example, Gonzalez et al., 1999, Bioconjugate Chem., 10, 1068-1074; Wang et al., International PCT Publication Nos. WO 03/47518 and WO 03/46185), poly(lactic-co-glycolic)acid (PLGA) and PLCA microspheres (see for example U.S. Pat. No. 6,447,796 and US Patent Application Publication No. US 2002130430), biodegradable nanocapsules, and bioadhesive microspheres, or by proteinaceous vectors (O'Hare and Normand, International PCT Publication No. WO 00/53722).

In one aspect, the present invention provides carrier systems containing the siNA molecules described herein. In some embodiments, the carrier system is a lipid-based carrier system, cationic lipid, or liposome nucleic acid complexes, a liposome, a micelle, a virosome, a lipid nanoparticle or a mixture thereof. In other embodiments, the carrier system is a polymer-based carrier system such as a cationic polymer-nucleic acid complex. In additional embodiments, the carrier system is a cyclodextrin-based carrier system such as a cyclodextrin polymer-nucleic acid complex. In further embodiments, the carrier system is a protein-based carrier system such as a cationic peptide-nucleic acid complex. Preferably, the carrier system is a lipid nanoparticle ("LNP") formulation.

In certain embodiments, the siNA molecules of the invention are formulated with a lipid nanoparticle composition such as is described in U.S. patent application Ser. Nos. 11/353,630, 11/586,102, 61/189,295, 61/204,878, 61/235,476, 61/249,807, 61/298,022, 61/351,373, 61/347,640, 61/345,754, 61/322,054, 12/640,342, and 12/617,079, and PCT Applications Nos. PCT/US10/020,013 and PCT/US09/053,336. In certain embodiments, the siNA is formulated with components and ratios described and exemplified in Example 6 herein (see also Tables 10 & 11).

In various embodiments, lipid nanoparticle formulations described in Table 10 are applied to any siNA molecule or combination of siNA molecules herein. In some embodiments, the invention features a composition comprising an siNA molecule of the invention formulated as a composition including any of cationic lipid compound numbers 1-46 or a combination thereof.

In certain other embodiments, the invention features a composition comprising an siNA molecule of the invention formulated with any of the cationic lipid formulations described in U.S. Patent Application Nos. 61/189,295, 61/204,878, 61/235,476, 61/249,807, and 61/298,022.

In other embodiments, the invention features conjugates and/or complexes of siNA molecules of the invention. Such conjugates and/or complexes can be used to facilitate delivery of siNA molecules into a biological system, such as a cell. The conjugates and complexes provided by the instant invention can impart therapeutic activity by transferring therapeutic compounds across cellular membranes, altering the pharmacokinetics, and/or modulating the localization of nucleic acid molecules of the invention. Non-limiting, examples of such conjugates are described in U.S. Publication Nos. US2008/0152661 A1 and US 2004/0162260 A1 (e.g., CDM-LBA, CDM-Pip-LBA, CDM-PEG, CDM-NAG, etc.) and U.S. patent application Ser. Nos. 10/427,160 10/201,394, 61/322,422, and 61/315,223; and U.S. Pat. Nos. 6,528,631; 6,335,434; 6,235,886; 6,153,737; 5,214,136; and 5,138,045.

In various embodiments, polyethylene glycol (PEG) can be covalently attached to siNA compounds of the present invention. The attached PEG can be any molecular weight, preferably from about 100 to about 50,000 daltons (Da).

In yet other embodiments, the invention features compositions or formulations comprising surface-modified liposomes containing poly (ethylene glycol) lipids (PEG-modified, or long-circulating liposomes or stealth liposomes) and siNA molecules of the invention, such as is disclosed in for example, International PCT Publication No. WO 96/10391; Ansell et al., International PCT Publication No. WO 96/10390; Holland et al., International PCT Publication No. WO 96/10392.

In some embodiments, the siNA molecules of the invention can also be formulated or complexed with polyethyleneimine and derivatives thereof, such as polyethyleneimine-polyethyleneglycol-N-acetylgalactosamine (PEI-PEG-GAL) or polyethylene imine-polyethyleneglycol-tri-N-acetylgalactosamine (PEI-PEG-triGAL) derivatives. In one embodiment, the nucleic acid molecules of the invention are formulated as described in U.S. Patent Application Publication No. 20030077829.

In other embodiments, siNA molecules of the invention are complexed with membrane disruptive agents such as those described in U.S. Patent Application Publication No. 20010007666. In still other embodiments, the membrane disruptive agent or agents and the siNA molecule are also complexed with a cationic lipid or helper lipid molecule, such as those lipids described in U.S. Pat. No. 6,235,310.

In certain embodiments, siNA molecules of the invention are complexed with delivery systems as described in U.S. Patent Application Publication Nos. 2003077829; 20050287551; 20050164220; 20050191627; 20050118594; 20050153919; 20050085486; and 20030158133; and International PCT Publication Nos. WO 00/03683 and WO 02/087541.

In some embodiments, a liposomal formulation of the invention comprises an siNA molecule of the invention (e.g., siNA) formulated or complexed with compounds and compositions described in U.S. Pat. Nos. 6,858,224; 6,534,484; 6,287,591; 6,835,395; 6,586,410; 6,858,225; 6,815,432; 6,586,001; 6,120,798; 6,977,223; 6,998,115; 5,981,501; 5,976,567; 5,705,385; and U.S. Patent Application Publication Nos. 2006/0019912; 2006/0019258; 2006/0008909; 2005/0255153; 2005/0079212; 2005/0008689; 2003/0077829, 2005/0064595, 2005/0175682, 2005/0118253; 2004/0071654; 2005/0244504; 2005/0265961 and 2003/0077829.

Alternatively, recombinant plasmids and viral vectors, as discussed above, which express siNAs of the invention can be used to deliver the molecules of the invention. Delivery of siNA molecule expressing vectors can be systemic, such as by intravenous or intra-muscular administration, by administration to target cells ex-planted from a subject followed by reintroduction into the subject, or by any other means that would allow for introduction into the desired target cell (for a review see Couture et al., 1996, TIG., 12, 510). Such recombinant plasmids can also be administered directly or in conjunction with a suitable delivery reagents, including, for example, the Minis Transit LT1 lipophilic reagent; lipofectin; lipofectamine; cellfectin; polycations (e.g., polylysine) or liposomes lipid-based carrier system, cationic lipid, or liposome nucleic acid complexes, a micelle, a virosome, a lipid nanoparticle.

E. Kits

The present invention also provides nucleic acids in kit form. The kit may comprise a container. The kit typically contains a nucleic acid of the invention with instructions for its administration. In certain instances, the nucleic acids may have a targeting moiety attached. Methods of attaching targeting moieties (e.g. antibodies, proteins) are known to those of skill in the art. In certain instances, the nucleic acids are chemically modified. In other embodiments, the kit contains more than one siNA molecule of the invention. The kits may comprise an siNA molecule of the invention with a pharmaceutically acceptable carrier or diluent. The kits may further comprise excipients.

F. Therapeutic Uses/Pharmaceutical Compositions

The present body of knowledge in HBV research indicates the need for methods to assay HBV activity and for compounds that can regulate HBV expression for research, diagnostic, and therapeutic use. As described infra, the nucleic acid molecules of the present invention can be used in assays to diagnose disease state related of HBV levels. In addition, the nucleic acid molecules and pharmaceutical compositions can be used to treat disease states related to HBV RNA levels.

1. Disease States Associated with HBV

Particular disease states that can be associated with HBV expression modulation include liver disease and cancer. Non-limiting examples of such diseases include cirrhosis of the liver and heptocellular carcinoma.

It is understood that the siNA molecules of the invention can degrade the target HBV mRNA (and thus inhibit the diseases stated above). Inhibition of a disease can be evaluated by directly measuring the progress of the disease in a subject. It can also be inferred through observing a change or reversal in a condition associated with the disease. Additionally, the siNA molecules of the invention can be used as a prophylaxis. Thus, the use of the nucleic acid molecules and pharmaceutical compositions of the invention can be used to ameliorate, treat, prevent, and/or cure these diseases and others associated with regulation of HBV gene expression.

2. Pharmaceutical Compositions

The siNA molecules of the instant invention provide useful reagents and methods for a variety of therapeutic, prophylactic, cosmetic, veterinary, diagnostic, target validation, genomic discovery, genetic engineering, and pharmacogenomic applications.

a. Formulations

Thus, the present invention, in one aspect, also provides for pharmaceutical compositions of the siNA molecules described, i.e., compositions in a pharmaceutically acceptable carrier or diluent. These pharmaceutical compositions include salts, esters, or salts of such esters, of the above compounds, e.g., acid addition salts, for example, salts of hydrochloric, hydrobromic, hydroiodic, acetic acid, and benzene sulfonic acid. Other salts include for example, sodium, potassium, manganese, ammonium, and calcium salts. These formulations or compositions can comprise a pharmaceutically acceptable carrier or diluent as is generally known in the art.

In one embodiment, the invention features a pharmaceutical composition comprising an siNA molecule comprising at least a 15 nucleotide sequence of SEQ ID NO: 1. In another embodiment, the invention features a pharmaceutical composition comprising an siNA molecule comprising at least a 15 nucleotide sequence of SEQ ID NO: 452. In yet another embodiment, the invention features a pharmaceutical composition comprising an siNA molecule comprising at least a 15 nucleotide sequence of SEQ ID NO: 2. In still another embodiment, the invention features a pharmaceutical composition comprising an siNA molecule comprising at least a 15 nucleotide sequence of SEQ ID NO: 453. In another embodiment, the invention features a pharmaceutical composition comprising an siNA molecule comprising at least a 15 nucleotide sequence of SEQ ID NO: 3. In another embodiment, the invention features a pharmaceutical composition comprising an siNA molecule comprising at least a 15 nucleotide sequence of SEQ ID NO: 454. In another embodiment, the invention features a pharmaceutical composition comprising an siNA molecule comprising at least a 15 nucleotide sequence of SEQ ID NO: 4. In yet another embodiment, the invention features a pharmaceutical composition comprising an siNA molecule comprising at least a 15 nucleotide sequence of SEQ ID NO: 455. In still another embodiment, the invention features a pharmaceutical composition comprising an siNA molecule comprising formula (A).

The siNA molecules of the invention are preferably formulated as pharmaceutical compositions prior to administering to a subject, according to techniques known in the art. Pharmaceutical compositions of the present invention are characterized as being at least sterile and pyrogen-free. Methods for preparing pharmaceutical compositions of the invention are within the skill in the art for example as described in *Remington's Pharmaceutical Science*, 17$^{th}$ ed., Mack Publishing Company, Easton, Pa. (1985).

In some embodiments, pharmaceutical compositions of the invention (e.g. siNA and/or LNP formulations thereof) further comprise conventional pharmaceutical excipients and/or additives. Suitable pharmaceutical excipients include preservatives, flavoring agents, stabilizers, antioxidants, osmolality adjusting agents, buffers, and pH adjusting agents. Suitable additives include physiologically biocompatible buffers (e.g., trimethylamine hydrochloride), addition of chelants (such as, for example, DTPA or DTPA-bisamide) or calcium chelate complexes (as for example calcium DTPA, CaNaDTPA-bisamide), or, optionally, additions of calcium or sodium salts (for example, calcium chloride, calcium ascorbate, calcium gluconate or calcium lactate). In addition, antioxidants and suspending agents can be used.

Non-limiting examples of various types of formulations for local administration include ointments, lotions, creams, gels, foams, preparations for delivery by transdermal patches, powders, sprays, aerosols, capsules or cartridges for use in an inhaler or insufflator or drops (for example eye or nose drops), solutions/suspensions for nebulization, suppositories, pessaries, retention enemas and chewable or suckable tablets or pellets (for example for the treatment of aphthous ulcers) or liposome or microencapsulation preparations.

Ointments, creams and gels, can, for example, can be formulated with an aqueous or oily base with the addition of suitable thickening and/or gelling agent and/or solvents. Non limiting examples of such bases can thus, for example, include water and/or an oil such as liquid paraffin or a vegetable oil such as arachis oil or castor oil, or a solvent such as polyethylene glycol. Various thickening agents and gelling agents can be used depending on the nature of the base. Non-limiting examples of such agents include soft paraffin, aluminum stearate, cetostearyl alcohol, polyethylene glycols, woolfat, beeswax, carboxypolymethylene and cellulose derivatives, and/or glyceryl monostearate and/or non-ionic emulsifying agents.

In one embodiment lotions can be formulated with an aqueous or oily base and will in general also contain one or more emulsifying agents, stabilizing agents, dispersing agents, suspending agents or thickening agents.

In one embodiment powders for external application can be formed with the aid of any suitable powder base, for example, talc, lactose or starch. Drops can be formulated with an aqueous or non-aqueous base also comprising one or more dispersing agents, solubilizing agents, suspending agents or preservatives.

Compositions intended for oral use can be prepared according to any method known to the art for the manufacture of pharmaceutical compositions and such compositions can contain one or more such sweetening agents, flavoring agents, coloring agents or preservative agents in order to provide pharmaceutically elegant and palatable preparations. Tablets contain the active ingredient in admixture with non-toxic pharmaceutically acceptable excipients that are suitable for the manufacture of tablets. These excipients can be, for example, inert diluents; such as calcium carbonate, sodium carbonate, lactose, calcium phosphate or sodium phosphate; granulating and disintegrating agents, for example, corn starch, or alginic acid; binding agents, for example starch, gelatin or acacia; and lubricating agents, for example magnesium stearate, stearic acid or talc. The tablets can be uncoated or they can be coated by known techniques. In some cases such coatings can be prepared by known techniques to delay disintegration and absorption in the gastrointestinal tract and thereby provide a sustained action over a longer period. For example, a time delay material such as glyceryl monsterate or glyceryl distearate can be employed.

Formulations for oral use can also be presented as hard gelatin capsules wherein the active ingredient is mixed with an inert solid diluent, for example, calcium carbonate, calcium phosphate or kaolin, or as soft gelatin capsules wherein the active ingredient is mixed with water or an oil medium, for example peanut oil, liquid paraffin or olive oil.

Aqueous suspensions contain the active materials in a mixture with excipients suitable for the manufacture of aqueous suspensions. Such excipients are suspending agents, for example sodium carboxymethylcellulose, methylcellulose, hydropropyl-methylcellulose, sodium alginate, polyvinylpyrrolidone, gum tragacanth and gum acacia; dispersing or wetting agents can be a naturally-occurring phosphatide, for example, lecithin, or condensation products of an alkylene oxide with fatty acids, for example polyoxyethylene stearate; or condensation products of ethylene oxide with long chain aliphatic alcohols, for example heptadecaethyleneoxycetanol, or condensation products of ethylene oxide with partial esters derived from fatty acids and a hexitol such as polyoxyethylene sorbitol monooleate, or condensation products of ethylene oxide with partial esters derived from fatty acids and hexitol anhydrides, for example polyethylene sorbitan monooleate. The aqueous suspensions can also contain one or more preservatives, for example ethyl, or n-propyl p-hydroxybenzoate, one or more coloring agents, one or more flavoring agents, and one or more sweetening agents, such as sucrose or saccharin.

Oily suspensions can be formulated by suspending the active ingredients in a vegetable oil, for example arachis oil, olive oil, sesame oil or coconut oil, or in a mineral oil such as liquid paraffin. The oily suspensions can contain a thickening agent, for example beeswax, hard paraffin or cetyl alcohol. Sweetening agents and flavoring agents can be added to provide palatable oral preparations. These compositions can be preserved by the addition of an anti-oxidant such as ascorbic acid Pharmaceutical compositions of the invention can also be in the form of oil-in-water emulsions. The oily phase can be a vegetable oil or a mineral oil or mixtures of these. Suitable emulsifying agents can be naturally-occurring gums, for example gum acacia or gum tragacanth, naturally-occurring phosphatides, for example soy bean, lecithin, and esters or partial esters derived from fatty acids and hexitol, anhydrides, for example sorbitan monooleate, and condensation products of the said partial esters with ethylene oxide, for example polyoxyethylene sorbitan monooleate. The emulsions can also contain sweetening and flavoring agents.

Syrups and elixirs can be formulated with sweetening agents, for example glycerol, propylene glycol, sorbitol, glucose or sucrose. Such formulations can also contain a demulcent, a preservative and flavoring and coloring agents. The pharmaceutical compositions can be in the form of a sterile injectable aqueous or oleaginous suspension. This suspension can be formulated according to the known art using those suitable dispersing or wetting agents and suspending agents that have been mentioned above. The sterile injectable preparation can also be a sterile injectable solution or suspension in a non-toxic parentally acceptable diluent or solvent, for example as a solution in 1,3-butanediol. Among the acceptable vehicles and solvents that can be employed are water, Ringer's solution and isotonic sodium chloride solution. In addition, sterile, fixed oils are conventionally employed as a solvent or suspending medium. For this purpose, any bland fixed oil can be employed including synthetic mono-or diglycerides. In addition, fatty acids such as oleic acid find use in the preparation of injectables.

The nucleic acid molecules of the invention can also be administered in the form of suppositories, e.g., for rectal administration of the drug. These compositions can be prepared by mixing the drug with a suitable non-irritating excipient that is solid at ordinary temperatures but liquid at the rectal temperature and will therefore melt in the rectum to release the drug. Such materials include cocoa butter and polyethylene glycols.

Nucleic acid molecules of the invention can be administered parenterally in a sterile medium. The drug, depending on the vehicle and concentration used, can either be suspended or dissolved in the vehicle. Advantageously, adjuvants such as local anesthetics, preservatives and buffering agents can be dissolved in the vehicle.

In other embodiments, the siNA and LNP compositions and formulations provided herein for use in pulmonary delivery further comprise one or more surfactants. Suitable surfactants or surfactant components for enhancing the uptake of the compositions of the invention include synthetic and natural as well as full and truncated forms of surfactant protein A, surfactant protein B, surfactant protein C, surfactant protein D and surfactant Protein E, di-saturated phosphatidylcholine (other than dipalmitoyl), dipalmitoylphosphatidylcholine, phosphatidylcholine, phosphatidylglycerol, phosphatidylinositol, phosphatidylethanolamine, phosphatidylserine; phosphatidic acid, ubiquinones, lysophosphatidylethanolamine, lysophosphatidylcholine, palmitoyl-lysophosphatidylcholine, dehydroepiandrosterone, dolichols, sulfatidic acid, glycerol-3-phosphate, dihydroxyacetone phosphate, glycerol, glycero-3-phosphocholine, dihydroxyacetone, palmitate, cytidine diphosphate (CDP) diacylglycerol, CDP choline, choline, choline phosphate; as well as natural and artificial lamellar bodies which are the natural carrier vehicles for the components of surfactant, omega-3 fatty acids, polyenic acid, polyenoic acid, lecithin, palmitinic acid, non-ionic block copolymers of ethylene or propylene oxides, polyoxypropylene, monomeric and polymeric, polyoxyethylene, monomeric and polymeric, poly (vinyl amine) with dextran and/or alkanoyl side chains, Brij 35, Triton X-100 and synthetic surfactants ALEC, Exosurf, Survan and Atovaquone, among others. These surfactants can be used either as single or part of a multiple component surfactant in a formulation, or as covalently bound additions to the 5' and/or 3' ends of the nucleic acid component of a pharmaceutical composition herein.

b. Combinations

The siNAs and pharmaceutical formulations according to the invention can be administered to a subject alone or used in combination with or include one or more other therapeutic agents, for example, antiviral or anticancer agents. Thus, combinations of the presently disclosed compounds with other antiviral or anti-cancer or chemotherapeutic agents are within the scope of the invention Examples of anti-cancer or chemotherapeutic agents can be found in *Cancer Principles and Practice of Oncology* by V. T. Devita and S. Hellman (editors), 6$^{th}$ edition (Feb. 15, 2001), Lippincott Williams & Wilkins Publishers. A person of ordinary skill in the art would be able to discern which combinations of agents would be useful based on the particular characteristics of the drugs and the cancer involved. Such anti-cancer agents include, but are not limited to, the following: estrogen receptor modulators, androgen receptor modulators, retinoid receptor modulators, cytotoxic/cytostatic agents, antiproliferative agents, prenyl-protein transferase inhibitors, HMG-CoA reductase inhibitors and other angiogenesis inhibitors, inhibitors of cell proliferation and survival signaling, apoptosis inducing agents and agents that interfere with cell cycle checkpoints. The siNAs of the invention are also useful in combination with any therapeutic agent used in the treatment of HCC, for example, but not limitation sorafenib.

In a further embodiment, therefore, the invention provides a combination comprising an siNA molecule of the invention, such as for example, but not limitation, an siNA molecule comprising at least a 15 nucleotide sequence of SEQ ID NO: 1, SEQ ID NO: 1210, SEQ ID NO: 2, SEQ ID NO: 1211, SEQ ID NO: 3, SEQ ID NO: 1212, SEQ ID NO: 4, or SEQ ID NO:1213; or formula (A) or a pharmaceutically acceptable salt, solvate or physiologically functional derivative thereof together with one or more antiviral agents. In some embodiments, the antiviral is another HBV inhibitor.

In certain embodiments, the instant siNA molecules of the invention are useful in combination with known HBV antiviral agents including the following: Lamivudine (2',3'-dideoxy-3'-thiacytidine, commonly called 3TC), Peglnterferon-alpha2a, tenofovir, entecavir, telbivudine, adefovir.

Also, the invention provides a combination comprising an siNA molecule of the invention, such as for example, but not limitation, an siNA molecule comprising at least a 15 nucleotide sequence of SEQ ID NO: 1, SEQ ID NO: 452, SEQ ID NO: 2, SEQ ID NO: 453, SEQ ID NO: 3, SEQ ID NO: 454, SEQ ID NO: 4, or SEQ ID NO:455; or formula (A) or a pharmaceutically acceptable salt, solvate or physiologically functional derivative thereof together with one or more anti-cancer or chemotherapeutic agents.

In certain embodiments, the instant siNA molecules of the invention are useful in combination with known anti-cancer agents including the following: estrogen receptor modulators, androgen receptor modulators, retinoid receptor modulators, cytotoxic agents, antiproliferative agents, prenyl-protein transferase inhibitors, HMG-CoA reductase inhibitors, HIV protease inhibitors, reverse transcriptase inhibitors, and other angiogenesis inhibitors.

Examples of estrogen receptor modulators that can be used in combination with the compounds of the invention include, but are not limited to, tamoxifen, raloxifene, idoxifene, LY353381, LY117081, toremifene, fulvestrant, 4-[7-(2,2-dimethyl-1-oxopropoxy-4-methyl-2-[4-[2-(1-piperidinyl)ethoxy]phenyl]-2H-1-benzopyran-3-yl]-phenyl-2,2-dimethylpropanoate, 4,4'-dihydroxybenzophenone-2,4-dinitrophenyl-hydrazone, and SH646.

Examples of androgen receptor modulators that can be used in combination with the compounds of the invention include, but are not limited to, finasteride and other 5α-reductase inhibitors, nilutamide, flutamide, bicalutamide, liarozole, and abiraterone acetate.

Examples of such retinoid receptor modulators that can be used in combination with the compounds of the invention include, but are not limited to, bexarotene, tretinoin, 13-cis-retinoic acid, 9-cis-retinoic acid, α-difluoromethylornithine, ILX23-7553, trans-N-(4'-hydroxyphenyl)retinamide, and N-4-carboxyphenyl retinamide.

Examples of cytotoxic agents that can be used in combination with the compounds of the invention include, but are not limited to, sertenef, cachectin, ifosfamide, tasonermin, lonidamine, carboplatin, altretamine, prednimustine, dibromodulcitol, ranimustine, fotemustine, nedaplatin, oxaliplatin, temozolomide, heptaplatin, estramustine, improsulfan tosilate, trofosfamide, nimustine, dibrospidium chloride, pumitepa, lobaplatin, satraplatin, profiromycin, cisplatin, irofulven, dexifosfamide, cis-aminedichloro(2-methyl-pyridine)platinum, benzylguanine, glufosfamide, GPX100, (trans, trans, trans)-bis-mu-(hexane-1,6-diamine)-mu-[diamine-platinum(II)]bis[diamine(chloro)platinum(II)]tetrachloride, diarizidinylspermine, arsenic trioxide, 1-(11-dodecylamino-10-hydroxyundecyl)-3,7-dimethylxanthine, zorubicin, idarubicin, daunorubicin, bisantrene, mitoxantrone, pirarubicin, pinafide, valrubicin, amrubicin, antineoplaston, 3'-deamino-3'-morpholino-13-deoxo-10-hydroxycaminomycin, annamycin, galarubicin, elinafide, MEN10755, and 4-demethoxy-3-deamino-3-aziridinyl-4-methylsulphonyl-daunorubicin (see WO 00/50032).

An example of a hypoxia activatable compound that can be used in combination with the compounds of the invention is tirapazamine.

Examples of proteasome inhibitors that can be used in combination with the compounds of the invention include, but are not limited to, lactacystin and bortezomib.

Examples of microtubule inhibitors/microtubule-stabilising agents that can be used in combination with the compounds of the invention include, but are not limited to, paclitaxel, vindesine sulfate, 3',4'-didehydro-4'-deoxy-8'-norvincaleukoblastine, docetaxol, rhizoxin, dolastatin, mivobulin isethionate, auristatin, cemadotin, RPR109881, BMS184476, vinflunine, cryptophycin, 2,3,4,5,6-pentafluoro-N-(3-fluoro-4-methoxyphenyl)benzene sulfonamide, anhydrovinblastine, N,N-dimethyl-L-valyl-L-valyl-N-methyl-L-valyl-L-prolyl-L-proline-t-butylamide, TDX258, the epothilones (see for example U.S. Pat. Nos. 6,284,781 and 6,288,237) and BMS188797.

Some examples of topoisomerase inhibitors that can be used in combination with the compounds of the invention include, but are not limited to, are topotecan, hycaptamine, irinotecan, rubitecan, 6-ethoxypropionyl-3',4'-O-exo-benzylidene-chartreusin, 9-methoxy-N,N-dimethyl-5-nitropyrazolo[3,4,5-kl]acridine-2-(6H) propanamine, 1-amino-9-ethyl-5-fluoro-2,3-dihydro-9-hydroxy-4-methyl-1H,12H-benzo[de]pyrano[3',4':b,7]-indolizino [1,2b] quinoline-10, 13 (9H,15H)dione, lurtotecan, 7-[2-(N-isopropylamino)ethyl]-(20S)camptothecin, BNP1350, BNPI1100, BN80915, BN80942, etoposide phosphate, teniposide, sobuzoxane, 2'-dimethylamino-2'-deoxy-etoposide, GL331, N-[2-(dimethylamino)ethyl]-9-hydroxy-5,6-dimethyl-6H-pyrido[4,3-b]carbazole-1-carboxamide, asulacrine, (5a, 5 aB, 8aa,9b)-9-[2-[N-[2-(dimethylamino)ethyl]-N-methylamino]ethyl]-5-[4-hydroOxy-3,5-dimethoxyphenyl]-5,5a,6,8,8a,9-hexohydrofuro(3',4':6,7)naphtho(2,3-d)-1,3-dioxol-6-one, 2,3-(methylenedioxy)-5-methyl-7-hydroxy-8-methoxybenzo[c]-phenanthridinium, 6,9-bis[(2-aminoethyl)amino]benzo[g]isoquinoline-5,10-dione, 5-(3-aminopropylamino)-7,10-dihydroxy-2-(2-hydroxyethylaminomethyl)-6H-pyrazolo[4,5,1-de]acridin-6-one, N-[1-[2 (diethylamino) ethylamino]-7-methoxy-9-oxo-9H-thioxanthen-4-ylmethyl] formamide, N-(2-(dimethylamino)ethyl)acridine-4-carboxamide, 6-[[2-(dimethylamino)ethyl]amino]-3-hydroxy-7H-indeno[2,1-c]quinolin-7-one, and dimesna.

Examples of inhibitors of mitotic kinesins, and in particular the human mitotic kinesin KSP, that can be used in combination with the compounds of the invention include, but are not limited to, inhibitors described in PCT Publications WO 01/30768, WO 01/98278, WO 03/050,064, WO 03/050,122, WO 03/049,527, WO 03/049,679, WO 03/049,678, WO04/039774, WO03/079973, WO03/099211, WO03/105855, WO03/106417, WO04/037171, WO04/058148, WO04/058700, WO04/126699, WO05/018638, WO05/019206, WO05/019205, WO05/018547, WO05/017190, US2005/0176776. In an embodiment inhibitors of mitotic kinesins include, but are not limited to inhibitors of KSP, inhibitors of MKLP1, inhibitors of CENP-E, inhibitors of MCAK, inhibitors of Kif14, inhibitors of Mphosph1 and inhibitors of Rab6-KIFL.

Examples of "histone deacetylase inhibitors" that can be used in combination with the compounds of the invention include, but are not limited to, TSA, oxamflatin, PXD101, MG98, valproic acid and scriptaid. Further reference to other histone deacetylase inhibitors may be found in the following manuscript; Miller, T. A. et al. J. Med. Chem. 46(24):5097-5116 (2003).

Inhibitors of kinases involved in mitotic progression that can be used in combination with the compounds of the invention include, but are not limited to, inhibitors of aurora kinase, inhibitors of Polo-like kinases (PLK) (in particular inhibitors of PLK-1), inhibitors of bub-1 and inhibitors of bub-R1.

Antiproliferative agents that can be used in combination with the compounds of the invention include, but are not limited to, antisense RNA and DNA oligonucleotides such as G3139, ODN698, RVASKRAS, GEM231, and INX3001, and antimetabolites such as enocitabine, carmofur, tegafur, pentostatin, doxifluridine, trimetrexate, fludarabine, capecitabine, galocitabine, cytarabine ocfosfate, fosteabine sodium hydrate, raltitrexed, paltitrexid, emitefur, tiazofurin, decitabine, nolatrexed, pemetrexed, nelzarabine, 2'-deoxy-2'-methylidenecytidine, 2'-fluoromethylene-2'-deoxycytidine, N-[5-(2,3-dihydro-benzofuryl)sulfonyl]-N'-(3,4-dichlorophenyl) urea, N6-[4-deoxy-4-[N2-[2(E),4(E)-tetradecadienoyl] glycylamino]-L-glycero-B-L-manno-heptopyranosyl] adenine, aplidine, ecteinascidin, troxacitabine, 4-[2-amino-4-oxo-4,6,7,8-tetrahydro-3H-pyrimidino [5,4-b][1,4] thiazin-6-yl-(S)-ethyl]-2,5-thienoyl-L-glutamic acid, aminopterin, 5-fluorouracil, alanosine, 11-acetyl-8-(carbamoyloxymethyl)-4-formyl-6-methoxy-14-oxa-1,1'-diazatetracyclo(7.4.1.0.0)-tetradeca-2,4,6-trien-9-yl acetic acid ester, swainsonine, lometrexol, dexrazoxane, methioninase, 2'-cyano-2'-deoxy-N4-palmitoyl-1-B-D-arabino furanosyl cytosine and 3-aminopyridine-2-carboxaldehyde thiosemicarbazone.

Examples of monoclonal antibody targeted therapeutic agents that can be used in combination with the compounds of the invention include those therapeutic agents which have cytotoxic agents or radioisotopes attached to a cancer cell specific or target cell specific monoclonal antibody, such as, for example, Bexxar.

Examples of HMG-CoA reductase inhibitors that may be used that can be used in combination with the compounds of the invention include, but are not limited to, lovastatin (MEVACOR®; see U.S. Pat. Nos. 4,231,938, 4,294,926 and 4,319,039), simvastatin (ZOCOR®; see U.S. Pat. Nos. 4,444,784, 4,820,850 and 4,916,239), pravastatin (PRAVACHOL®; see U.S. Pat. Nos. 4,346,227, 4,537,859, 4,410,629, 5,030,447 and 5,180,589), fluvastatin (LESCOL®; see U.S. Pat. Nos. 5,354,772, 4,911,165, 4,929,437, 5,189,164, 5,118,853, 5,290,946 and 5,356,896) and atorvastatin (LIPITOR®; see U.S. Pat. Nos. 5,273,995, 4,681,893, 5,489,691 and 5,342,952). The structural formulas of these and additional HMG-CoA reductase inhibitors that may be used in the instant methods are described at page 87 of M. Yalpani, "Cholesterol Lowering Drugs", Chemistry & Industry, pp. 85-89 (5 Feb. 1996) and U.S. Pat. Nos. 4,782,084 and 4,885,314.

Examples of prenyl-protein transferase inhibitors that can be used in combination with the compounds of the invention include, but are not limited to, can be found in the following publications and patents: WO 96/30343, WO 97/18813, WO 97/21701, WO 97/23478, WO 97/38665, WO 98/28980, WO 98/29119, WO 95/32987, U.S. Pat. No. 5,420,245, U.S. Pat. No. 5,523,430, U.S. Pat. No. 5,532,359, U.S. Pat. No. 5,510,510, U.S. Pat. No. 5,589,485, U.S. Pat. No. 5,602,098, European Patent Publ. 0 618 221, European Patent Publ. 0 675 112, European Patent Publ. 0 604 181, European Patent Publ. 0 696 593, WO 94/19357, WO 95/08542, WO 95/11917, WO 95/12612, WO 95/12572, WO 95/10514, U.S. Pat. No. 5,661,152, WO 95/10515, WO 95/10516, WO 95/24612, WO 95/34535, WO 95/25086, WO 96/05529, WO 96/06138, WO 96/06193, WO 96/16443, WO 96/21701, WO 96/21456, WO 96/22278, WO 96/24611, WO 96/24612, WO 96/05168, WO 96/05169, WO 96/00736, U.S. Pat. No. 5,571,792, WO 96/17861, WO 96/33159, WO 96/34850, WO 96/34851, WO 96/30017, WO 96/30018, WO 96/30362, WO 96/30363, WO 96/31111, WO 96/31477, WO 96/31478, WO 96/31501, WO 97/00252, WO 97/03047, WO 97/03050, WO 97/04785, WO 97/02920, WO 97/17070, WO 97/23478, WO 97/26246, WO 97/30053, WO 97/44350, WO 98/02436, and U.S. Pat. No. 5,532,359. For an example of the role of a prenyl-protein transferase inhibitor on angiogenesis see European J. of Cancer, Vol. 35, No. 9, pp. 1394-1401 (1999).

Examples of angiogenesis inhibitors that can be used in combination with the compounds of the invention include, but are not limited to, tyrosine kinase inhibitors, such as inhibitors of the tyrosine kinase receptors Flt-1 (VEGFR1) and Flk-1/KDR (VEGFR2), inhibitors of epidermal-derived, fibroblast-derived, or platelet derived growth factors, MMP (matrix metalloprotease) inhibitors, integrin blockers, interferon-α, interleukin-12, pentosan polysulfate, cyclooxygenase inhibitors, including nonsteroidal anti-inflammatories (NSAIDs) like aspirin and ibuprofen as well as selective cyclooxy-genase-2 inhibitors like celecoxib and rofecoxib (PNAS, Vol. 89, p. 7384 (1992); JNCI, Vol. 69, p. 475 (1982); Arch. Opthalmol., Vol. 108, p. 573 (1990); Anat. Rec., Vol. 238, p. 68 (1994); FEBS Letters, Vol. 372, p. 83 (1995); Clin. Orthop. Vol. 313, p. 76 (1995); J. Mol. Endocrinol., Vol. 16, p. 107 (1996); Jpn. J. Pharmacol., Vol. 75, p. 105 (1997); Cancer Res., Vol. 57, p. 1625 (1997); Cell, Vol. 93, p. 705 (1998); Intl. J. Mol. Med., Vol. 2, p. 715 (1998); J. Biol. Chem., Vol. 274, p. 9116 (1999)), steroidal anti-inflammatories (such as corticosteroids, mineralocorticoids, dexamethasone, prednisone, prednisolone, methylpred, betamethasone), carboxyamidotriazole, combretastatin A-4, squalamine, 6-O-chloroacetyl-carbonyl)-fumagillol, thalidomide, angiostatin, troponin-1, angiotensin II antagonists (see Fernandez et al., J. Lab. Clin. Med. 105:141-145 (1985)), and antibodies to VEGF (see, Nature Biotechnology, Vol. 17, pp. 963-968 (October 1999); Kim et al., Nature, 362, 841-844 (1993); WO 00/44777; and WO 00/61186).

Other therapeutic agents that modulate or inhibit angiogenesis may also be used in combination with the compounds of the instant invention and include agents that modulate or inhibit the coagulation and fibrinolysis systems (see review in Clin. Chem. La. Med. 38:679-692 (2000)). Examples of such agents that modulate or inhibit the coagulation and fibrinolysis pathways that can be used in combination with the compounds of the invention include, but are not limited to, heparin (see Thromb. Haemost. 80:10-23 (1998)), low molecular weight heparins and carboxypeptidase U inhibitors (also known as inhibitors of active thrombin activatable fibrinolysis inhibitor [TAFIa]) (see Thrombosis Res. 101:329-354 (2001)). TAFIa inhibitors have been described in PCT Publication WO 03/013,526 and U.S. Ser. No. 60/349,925 (filed Jan. 18, 2002).

Agents that interfere with cell cycle checkpoints that can be used in combination with the compounds of the invention include, but are not limited to, inhibitors of ATR, ATM, the Chk1 and Chk2 kinases and cdk and cdc kinase inhibitors and are specifically exemplified by 7-hydroxystaurosporin, flavopiridol, CYC202 (Cyclacel) and BMS-387032.

Agents that interfere with receptor tyrosine kinases (RTKs) that can be used in combination with the compounds of the invention include, but are not limited to, inhibitors of c-Kit, Eph, PDGF, Flt3 and HBV. Further agents include inhibitors of RTKs as described by Bume-Jensen and Hunter, *Nature*, 411:355-365, 2001.

Inhibitors of cell proliferation and survival signaling pathway that can be used in combination with the compounds of the invention include, but are not limited to, inhibitors of EGFR (for example gefitinib and erlotinib), inhibitors of ERB-2 (for example trastuzumab), inhibitors of IGFR, inhibitors of cytokine receptors, inhibitors of HBV, inhibitors of PI3K (for example LY294002), serine/threonine kinases (including but not limited to inhibitors of Akt such as described in WO 02/083064, WO 02/083139, WO 02/083140, US 2004-0116432, WO 02/083138, US 2004-0102360, WO 03/086404, WO 03/086279, WO 03/086394, WO 03/084473, WO 03/086403, WO 2004/041162, WO 2004/096131, WO 2004/096129, WO 2004/096135, WO 2004/096130, WO 2005/100356, WO 2005/100344), inhibitors of Raf kinase (for example BAY-43-9006), inhibitors of MEK (for example CI-1040 and PD-098059) and inhibitors of mTOR (for example Wyeth CCI-779). Such agents include small molecule inhibitor compounds and antibody antagonists.

Apoptosis inducing agents that can be used in combination with the compounds of the invention include, but are not limited to, activators of TNF receptor family members (including the TRAIL receptors).

NSAIDs that are selective COX-2 inhibitors that can be used in combination with the compounds of the invention include, but are not limited to, those NSAIDs disclosed in U.S. Pat. No. 5,474,995, U.S. Pat. No. 5,861,419, U.S. Pat. No. 6,001,843, U.S. Pat. No. 6,020,343, U.S. Pat. No. 5,409,944, U.S. Pat. No. 5,436,265, U.S. Pat. No. 5,536,752, U.S. Pat. No. 5,550,142, U.S. Pat. No. 5,604,260, U.S. Pat. No. 5,698,584, U.S. Pat. No. 5,710,140, WO 94/15932, U.S. Pat. No. 5,344,991, U.S. Pat. No. 5,134,142, U.S. Pat. No. 5,380,738, U.S. Pat. No. 5,393,790, U.S. Pat. No. 5,466,823, U.S. Pat. No. 5,633,272, and U.S. Pat. No. 5,932,598, all of which are hereby incorporated by reference.

Inhibitors of COX-2 that are particularly useful in combination with the compounds of the invention include: 3-phenyl-4-(4-(methylsulfonyl)phenyl)-2-(5H)-furanone; and 5-chloro-3-(4-methylsulfonyl)-phenyl-2-(2-methyl-5-pyridinyl)pyridine; or a pharmaceutically acceptable salt thereof.

Compounds that have been described as specific inhibitors of COX-2 and are therefore useful in the present invention include, but are not limited to: parecoxib, CELEBREX® and BEXTRA® or a pharmaceutically acceptable salt thereof.

Angiogenesis inhibitors that can be used in combination with the compounds of the invention include, but are not limited to, endostatin, ukrain, ranpirnase, IM862, 5-methoxy-4-[2-methyl-3-(3-methyl-2-butenyl)oxiranyl]-1-oxaspiro[2,5]oct-6-yl(chloroacetyl)carbamate, acetyldinanaline, 5-amino-1-[[3,5-dichloro-4-(4-chlorobenzoyl)-phenyl]methyl]-1H-1,2,3-triazole-4-carboxamide,CM101, squalamine, combretastatin, RPI4610, NX31838, sulfated mannopentaose phosphate, 7,7-(carbonyl-bis [imino-N-methyl-4,2-pyrrolocarbonylimino[N-methyl-4,2-pyrrole]-carbonylimino]-bis-(1,3-naphthalene disulfonate), and 3-[(2,4-dimethylpyrrol-5-yl)methylene]-2-indolinone (SU5416).

Tyrosine kinase inhibitors that can be used in combination with the compounds of the invention include, but are not limited to, N-(trifluoromethylphenyl)-5-methylisoxazol-4-carboxamide, 3-[(2,4-dimethylpyrrol-5-yl)methylidenyl)indolin-2-one, 17-(allylamino)-17-demethoxygeldanamycin, 4-(3-chloro-4-fluorophenylamino)-7-methoxy-6-[3-(4-morpholinyl)propoxyl]quinazoline, N-(3-ethynylphenyl)-6,7-bis(2-methoxyethoxy)-4-quinazolinamine, BIBX1382, 2,3,9,10,11,12-hexahydro-10-(hydroxymethyl)-10-hydroxy-9-methyl-9,12-epoxy-1H-diindolo[1,2,3-fg:3',2',1'-kl]pyrrolo[3,4-i][1,6]benzodiazocin-1-one, SH268, genistein, imatinib (STI571), CEP2563, 4-(3-chlorophenylamino)-5,6-dimethyl-7H-pyrrolo[2,3-d]pyrimidinemethane sulfonate, 4-(3-bromo-4-hydroxyphenyl)amino-6,7-dimethoxyquinazoline, 4-(4'-hydroxyphenyl)amino-6,7-dimethoxyquinazoline, SU6668, STI571A, N-4-chlorophenyl-4-(4-pyridylmethyl)-1-phthalazinamine, and EMD121974.

Combinations with compounds other than anti-cancer compounds are also encompassed in the instant compositions and methods. For example, combinations of the instantly claimed compounds with PPAR-γ (i.e., PPAR-gamma) agonists and PPAR-δ (i.e., PPAR-delta) agonists are useful in the treatment of certain malignancies. PPAR-γ and PPAR-δ are the nuclear peroxisome proliferator-activated receptors γ and δ. The expression of PPAR-γ on endothelial cells and its involvement in angiogenesis has been reported in the literature (see *J. Cardiovasc. Pharmacol.* 31:909-913 (1998); *J. Biol. Chem.* 274:9116-9121 (1999); *Invest. Ophthalmol. Vis. Sci.* 41:2309-2317 (2000)). More recently, PPAR-γ agonists have been shown to inhibit the angiogenic response to VEGF in vitro; both troglitazone and rosiglitazone maleate inhibit the development of retinal neovascularization in mice. (*Arch. Ophthamol.* 119:709-717 (2001)). Examples of PPAR-γ agonists and PPAR-γ/α agonists that can be used in combination with the compounds of the invention include, but are not limited to, thiazolidinediones (such as DRF2725, CS-011, troglitazone, rosiglitazone, and pioglitazone), fenofibrate, gemfibrozil, clofibrate, GW2570, SB219994, AR-H039242, JTT-501, MCC-555, GW2331, GW409544, NN2344, KRP297, NP0110, DRF4158, NN622, G1262570, PNU182716, DRF552926, 2-[(5,7-dipropyl-3-trifluoromethyl-1,2-benzisoxazol-6-yl)oxy]-2-methylpropionic acid (disclosed in U.S. Ser. No. 09/782,856), and 2(R)-7-(3-(2-chloro-4-(4-fluorophenoxy)phenoxy)propoxy)-2-ethylchromane-2-carboxylic acid (disclosed in U.S. Ser. No. 60/235,708 and 60/244,697).

Another embodiment of the instant invention is the use of the presently disclosed compounds in combination with gene therapy for the treatment of cancer. For an overview of genetic strategies to treating cancer see Hall et al. (*Am J Hum Genet.* 61:785-789 (1997)) and Kufe et al. (*Cancer Medicine*, 5th Ed, pp 876-889, BC Decker, Hamilton, 2000). Gene therapy can be used to deliver any tumor suppressing gene. Examples of such genes include, but are not limited to, p53, which can be delivered via recombinant virus-mediated gene transfer (see U.S. Pat. No. 6,069,134, for example), a uPA/uPAR antagonist ("Adenovirus-Mediated Delivery of a uPA/uPAR Antagonist Suppresses Angiogenesis-Dependent Tumor Growth and Dissemination in Mice," *Gene Therapy*, August 5(8):1105-13 (1998)), and interferon gamma (*J Immunol* 164:217-222 (2000)).

The compounds of the instant invention may also be administered in combination with an inhibitor of inherent multidrug resistance (MDR), in particular MDR associated with high levels of expression of transporter proteins. Such MDR inhibitors include inhibitors of p-glycoprotein (P-gp), such as LY335979, XR9576, OC144-093, R101922, VX853 and PSC833 (valspodar).

A compound of the present invention may be employed in conjunction with anti-emetic agents to treat nausea or emesis, including acute, delayed, late-phase, and anticipatory emesis, which may result from the use of a compound of the present invention, alone or with radiation therapy. For the prevention or treatment of emesis, a compound of the present invention may be used in conjunction with other anti-emetic agents, especially neurokinin-1 receptor antagonists, 5HT3 receptor antagonists, such as ondansetron, granisetron, tropisetron, and zatisetron, GABAB receptor agonists, such as baclofen, a corticosteroid such as Decadron (dexamethasone), Kenalog, Aristocort, Nasalide, Preferid, Benecorten or others such as disclosed in U.S. Pat. Nos. 2,789,118, 2,990,401, 3,048,581, 3,126,375, 3,929,768, 3,996,359, 3,928,326 and 3,749,712, an antidopaminergic, such as the phenothiazines (for example prochlorperazine, fluphenazine, thioridazine and mesoridazine), metoclopramide or dronabinol. In an embodiment, an anti-emesis agent selected from a neurokinin-1 receptor antagonist, a 5HT3 receptor antagonist and a corticosteroid is administered as an adjuvant for the treatment or prevention of emesis that may result upon administration of the instant compounds.

Neurokinin-1 receptor antagonists of use in conjunction with the compounds of the present invention are fully described, for example, in U.S. Pat. Nos. 5,162,339, 5,232,929, 5,242,930, 5,373,003, 5,387,595, 5,459,270, 5,494,926, 5,496,833, 5,637,699, 5,719,147; European Patent Publication Nos. EP 0 360 390, 0 394 989, 0 428 434, 0 429 366, 0 430 771, 0 436 334, 0 443 132, 0 482 539, 0 498 069, 0 499 313, 0 512 901, 0 512 902, 0 514 273, 0 514 274, 0 514 275, 0 514 276, 0 515 681, 0 517 589, 0 520 555, 0 522 808, 0 528 495, 0 532 456, 0 533 280, 0 536 817, 0 545 478, 0 558 156, 0 577 394, 0 585 913, 0 590 152, 0 599 538, 0 610 793, 0 634 402, 0 686 629, 0 693 489, 0 694 535, 0 699 655, 0 699 674, 0 707 006, 0 708 101, 0 709 375, 0 709 376, 0 714 891, 0 723 959, 0 733 632 and 0 776 893; PCT International Patent Publication Nos. WO 90/05525, 90/05729, 91/09844, 91/18899, 92/01688, 92/06079, 92/12151, 92/15585, 92/17449, 92/20661, 92/20676, 92/21677, 92/22569, 93/00330, 93/00331, 93/01159, 93/01165, 93/01169, 93/01170, 93/06099, 93/09116, 93/10073, 93/14084, 93/14113, 93/18023, 93/19064, 93/21155, 93/21181, 93/23380, 93/24465, 94/00440, 94/01402, 94/02461, 94/02595, 94/03429, 94/03445, 94/04494, 94/04496, 94/05625, 94/07843, 94/08997, 94/10165, 94/10167, 94/10168, 94/10170, 94/11368, 94/13639, 94/13663, 94/14767, 94/15903, 94/19320, 94/19323, 94/20500, 94/26735, 94/26740, 94/29309, 95/02595, 95/04040, 95/04042, 95/06645, 95/07886, 95/07908, 95/08549, 95/11880, 95/14017, 95/15311, 95/16679, 95/17382, 95/18124, 95/18129, 95/19344, 95/20575, 95/21819, 95/22525, 95/23798, 95/26338, 95/28418, 95/30674, 95/30687, 95/33744, 96/05181, 96/05193, 96/05203, 96/06094, 96/07649, 96/10562, 96/16939, 96/18643, 96/20197, 96/21661, 96/29304, 96/29317, 96/29326, 96/29328, 96/31214, 96/32385, 96/37489, 97/01553, 97/01554, 97/03066, 97/08144, 97/14671, 97/17362, 97/18206, 97/19084, 97/19942 and 97/21702; and in British Patent Publication Nos. 2 266 529, 2 268 931, 2 269 170, 2 269 590, 2 271 774, 2 292 144, 2 293 168, 2 293 169, and 2 302 689. The preparation of such compounds is fully described in the aforementioned patents and publications, which are incorporated herein by reference.

In an embodiment, the neurokinin-1 receptor antagonist for use in conjunction with the compounds of the present invention is selected from: 2-(R)-(1-(R)-(3,5-bis(trifluoromethyl)-phenyl)ethoxy)-3-(S)-(4-fluorophenyl)-4-(3-(5-oxo-1H,4H-1,2,4-triazolo)methyl)morpholine, or a pharmaceutically acceptable salt thereof, which is described in U.S. Pat. No. 5,719,147.

A compound of the instant invention may also be administered with an agent useful in the treatment of anemia. Such an anemia treatment agent is, for example, a continuous erythropoiesis receptor activator (such as epoetin alfa).

A compound of the instant invention may also be administered with an agent useful in the treatment of neutropenia. Such a neutropenia treatment agent is, for example, a hematopoietic growth factor which regulates the production and function of neutrophils such as a human granulocyte colony stimulating factor, (G-CSF). Examples of a G-CSF include filgrastim and PEG-filgrastim.

A compound of the instant invention may also be administered with an immunologic-enhancing drug, such as levamisole, isoprinosine and Zadaxin.

A compound of the instant invention may also be useful for treating or preventing liver disease or cancer in combination with other siNA therapeutics.

The compounds of the instant invention may also be administered in combination with γ-secretase inhibitors and/or inhibitors of NOTCH signaling. Such inhibitors include compounds described in WO 01/90084, WO 02/30912, WO 01/70677, WO 03/013506, WO 02/36555, WO 03/093252, WO 03/093264, WO 03/093251, WO 03/093253, WO 2004/039800, WO 2004/039370, WO 2005/030731, WO 2005/014553, U.S. Ser. No. 10/957,251, WO 2004/089911, WO 02/081435, WO 02/081433, WO 03/018543, WO 2004/031137, WO 2004/031139, WO 2004/031138, WO 2004/101538, WO 2004/101539 and WO 02/47671 (including LY-450139).

A compound of the instant invention may also be useful for treating or preventing cancer in combination with PARP inhibitors.

A compound of the instant invention may also be useful for treating cancer in combination with the following therapeutic agents: abarelix (Plenaxis Depot®); aldesleukin (Prokine®); Aldesleukin (Proleukin®); Alemtuzumabb (Campath®); alitretinoin (Panretin®); allopurinol (Zyloprim®); altretamine (Hexylen®); amifostine (Ethyol®); anastrozole (Arimidex®); arsenic trioxide (Trisenox®); asparaginase (Elspar®); azacitidine (Vidaza®); bendamustine hydrochloride (Treanda®); bevacuzimab (Avastin®); bexarotene capsules (Targretin®); bexarotene gel (Targretin®); bleomycin (Blenoxane®); bortezomib (Velcade®); brefeldin A; busulfan intravenous (Busulfex®); busulfan oral (Myleran®); calusterone (Methosarb®); capecitabine (Xeloda®); carboplatin (Paraplatin®); carmustine (BCNU®, BiCNU®); carmustine (Gliadel®); carmustine with Polifeprosan 20 Implant (Gliadel Wafer®); celecoxib (Celebrex®); cetuximab (Erbitux®); chlorambucil (Leukeran®); cisplatin (Platinol®); cladribine (Leustatin 2-CdA®); clofarabine (Clolar®); cyclophosphamide (Cytoxan®, Neosar®); cyclophosphamide (Cytoxan Injection®); cyclophosphamide (Cytoxan Tablet®); cytarabine (Cytosar-U®); cytarabine liposomal (DepoCyt®); dacarbazine (DTIC-Dome®); dactinomycin, actinomycin D (Cosmegen®); dalteparin sodium injection (Fragmin®); Darbepoetin alfa (Aranesp®); dasatinib (Sprycel®); daunorubicin liposomal (DanuoXome®); daunorubicin, daunomycin (Daunorubicin®); daunorubicin, daunomycin (Cerubidine®); degarelix (Firmagon®); Denileukin diftitox (Ontak®); dexrazoxane (Zinecard®); dexrazoxane hydrochloride (Totect®); didemnin B; 17-DMAG; docetaxel (Taxotere®); doxorubicin (Adriamycin PFS®); doxorubicin (Adriamycin®, Rubex®); doxorubicin (Adriamycin PFS Injection®); doxorubicin liposomal (Doxil®); dromostanolone propionate (Dromostanolone®); dromostanolone propionate (Masterone Injection®); eculizumab injection (Soliris®); Elliott's B Solution (Elliott's B Solution®); eltrombopag (Promacta®); epirubicin (Ellence®); Epoetin alfa (Epogen®); erlotinib (Tarceva®); estramustine (Emcyt®); ethinyl estradiol; etoposide phosphate (Etopophos®); etoposide, VP-16 (Vepesid®); everolimus tablets (Afinitor®); exemestane (Aromasin®); ferumoxytol (Feraheme Injection®); Filgrastim (Neupogen®); floxuridine (intraarterial) (FUDR®); fludarabine (Fludara®); fluorouracil, 5-FU (Adrucil®); fulvestrant (Faslodex®); gefitinib (Iressa®); geldanamycin; gemcitabine (Gemzar®); gemtuzumab ozogamicin (Mylotarg®); goserelin acetate (Zoladex Implant®); goserelin acetate (Zoladex®); histrelin acetate (Histrelin Implant®); hydroxyurea (Hydrea®); Ibritumomab Tiuxetan (Zevalin®); idarubicin (Idamycin®); ifosfamide (IFEX®); imatinib mesylate (Gleevec®); interferon alfa 2a (Roferon A®); Interferon alfa-2b (Intron A®); iobenguane 1123 injection (AdreView®); irinotecan (Camptosar®); ixabepilone (Ixempra®); lapatinib tablets (Tykerb®); lenalidomide (Revlimid®); letrozole (Femara®); leucovorin (Wellcovorin®, Leucovorin®); Leuprolide Acetate (Eligard®); levamisole (Ergamisol®); lomustine, CCNU (CeeBU®); meclorethamine, nitrogen mustard (Mustargen®); megestrol acetate (Megace®); melphalan, L-PAM (Alkeran®); mercaptopurine, 6-MP (Purinethol®); mesna (Mesnex®); mesna (Mesnex Tabs®); methotrexate (Methotrexate®); methoxsalen (Uvadex®); 8-methoxypsoralen; mitomycin C (Mutamycin®); mitotane (Lysodren®); mitoxantrone (Novantrone®); mitramycin; nandrolone phenpropionate (Durabolin-50®); nelarabine (Arranon®); nilotinib (Tasigna®); Nofetumomab (Verluma®); ofatumumab (Arzerra®); Oprelvekin (Neumega®); oxaliplatin (Eloxatin®); paclitaxel (Paxene®); paclitaxel (Taxol®); paclitaxel protein-bound particles (Abraxane®); palifermin (Kepivance®); pamidronate (Aredia®); panitumumab (Vectibix®); pazopanib tablets (Votrienttm®); pegademase (Adagen (Pegademase Bovine)®); pegaspargase (Oncaspar®); Pegfilgrastim (Neulasta®); pemetrexed disodium (Alimta®); pentostatin (Nipent®); pipobroman (Vercyte®); plerixafor (Mozobil®); plicamycin, mithramycin (Mithracin®); porfimer sodium (Photofrin®); pralatrexate injection (Folotyn®); procarbazine (Matulane®); quinacrine (Atabrine®); rapamycin; Rasburicase (Elitek®); raloxifene hydrochloride (Evista®); Rituximab (Rituxan®); romidepsin (Istodax®); romiplostim (Nplate®); sargramostim (Leukine®); Sargramostim (Prokine®); sorafenib (Nexavar®); streptozocin (Zanosar®); sunitinib maleate (Sutent®); talc (Sclerosol®); tamoxifen (Nolvadex®); temozolomide (Temodar®); temsirolimus (Torisel®); teniposide, VM-26 (Vumon®); testolactone (Teslac®); thioguanine, 6-TG (Thioguanine®); thiopurine; thiotepa (Thioplex®); topotecan (Hycamtin®); toremifene (Fareston®); Tositumomab (Bexxar®); Tositumomab/I-131 tositumomab (Bexxar®); trans-retinoic acid; Trastuzumab (Herceptin®); tretinoin, ATRA (Vesanoid®); triethylenemelamine; Uracil Mustard (Uracil Mustard Capsules®); valrubicin (Valstar®); vinblastine (Velban®); vincristine (Oncovin®); vinorelbine (Navelbine®); vorinostat (Zolinza®); wortmannin; and zoledronate (Zometa®).

The combinations referred to above can conveniently be presented for use in the form of a pharmaceutical formulation and thus pharmaceutical compositions comprising a combination as defined above together with a pharmaceutically acceptable diluent or carrier represent a further aspect of the invention.

The individual compounds of such combinations can be administered either sequentially or simultaneously in separate or combined pharmaceutical formulations. In one embodiment, the individual compounds will be administered simultaneously in a combined pharmaceutical formulation.

Thus, the described molecules could be used in combination with one or more known compounds, treatments, or procedures to prevent or treat diseases, disorders, conditions, and traits described herein in a subject or organism as are known in the art, such as other HBV inhibitors.

3. Therapeutic Applications

The present body of knowledge in HBV research indicates the need for methods that can regulate HBV expression for therapeutic use.

Thus, one aspect of the invention comprises a method of treating a subject including, but not limited to, a human suffering HBV infection or a condition which is mediated by the action of HBV gene expression, which method comprises administering to said subject an effective amount of a double-stranded siNA molecule of the invention. In one embodiment of this aspect, the siNA molecules comprises at least a 15 nucleotide sequence of SEQ ID NO: 1, SEQ ID NO: 452, SEQ ID NO: 2, SEQ ID NO: 453, SEQ ID NO: 3, SEQ ID NO: 454, SEQ ID NO: 4, or SEQ ID NO:455; or formula (A).

In some embodiments of this aspect, the condition is cancer. Thus, in certain embodiments the molecules and compositions of the instant invention are useful in a method for treating cancer, and in particular, in treating hepatocellular carcinoma (HCC).

In some embodiments, the condition is liver disease. Thus, in certain embodiments the molecules and compositions of the instant invention are useful in a method for treating liver disease, and, in particular, in treating cirrhosis of the liver.

In certain embodiments, the administration of the siNA molecule is via local administration or systemic administration. In other embodiments, the invention features contacting the subject or organism with an siNA molecule of the invention via local administration to relevant tissues or cells, such as lung cells and tissues, such as via pulmonary delivery. In yet other embodiments, the invention features contacting the subject or organism with an siNA molecule of the invention via systemic administration (such as via intravenous or subcutaneous administration of siNA) to relevant tissues or cells, such as liver or cancerous tissues or cells in a subject or organism.

siNA molecules of the invention are also used as reagents in ex vivo applications. For example, siNA reagents are introduced into tissue or cells that are transplanted into a subject for therapeutic effect. The cells and/or tissue can be derived from an organism or subject that later receives the explant, or can be derived from another organism or subject prior to transplantation. The siNA molecules can be used to modulate the expression of one or more genes in the cells or tissue, such that the cells or tissue obtain a desired phenotype or are able to perform a function when transplanted in vivo. In one embodiment, certain HBV target cells from a patient are extracted. These extracted cells are contacted with HBV siNAs targeting a specific nucleotide sequence within the cells under conditions suitable for uptake of the siNAs by these cells (e.g., using delivery reagents such as cationic lipids, liposomes and the like or using techniques such as electroporation to facilitate the delivery of siNAs into cells). The cells are then reintroduced back into the same patient or other patients.

For therapeutic applications, a pharmaceutically effective dose of the siNA molecules or pharmaceutical compositions of the invention is administered to the subject. A pharmaceutically effective dose is that dose required to prevent, inhibit the occurrence, or treat (alleviate a symptom to some extent, preferably all of the symptoms) a disease state. One skilled in the art can readily determine a therapeutically effective dose of the siNA of the invention to be administered to a given subject, by taking into account factors, such as the size and weight of the subject, the extent of the disease progression or penetration, the age, health, and sex of the subject, the route of administration, and whether the administration is regional or systemic. Generally, an amount between 0.1 µg/kg and 100 mg/kg body weight/day of active ingredients is administered dependent upon potency of the negatively charged polymer. Optimal dosing schedules can be calculated from measurements of drug accumulation in the body of the patient. The siNA molecules of the invention can be administered in a single dose or in multiple doses.

siNA molecules of the instant invention can be administered once monthly, once weekly, once daily (QD), or divided into multiple monthly, weekly, or daily doses, such as, for example, but not limitation, twice daily (BID), three times daily (TID), once every two weeks. Persons of ordinary skill in the art can easily estimate repetition rates for dosing based on measured residence times and concentrations of the drug in bodily fluids or tissues.

In addition, the administration can be continuous, i.e., every day, or intermittently. For example, intermittent administration of a compound of the instant invention may be administration one to six days per week or it may mean administration in cycles (e.g. daily administration for two to eight consecutive weeks, then a rest period with no administration for up to one week) or it may mean administration on alternate days.

G. Administration

Compositions or formulations can be administered in a variety of ways. Non-limiting examples of administration methods of the invention include oral, buccal, sublingual, parenteral (i.e., intraarticularly, intravenously, intraperitoneally, subcutaneously, or intramuscularly), local rectal administration or other local administration. In one embodiment, the composition of the invention can be administered by insufflation and inhalation. Administration can be accomplished via single or divided doses. In some embodiments, the pharmaceutical compositions are administered intravenously or intraperitoneally by a bolus injection (see, e.g., U.S. Pat. No. 5,286,634). Lipid nucleic acid particles can be administered by direct injection at the site of disease or by injection at a site distal from the site of disease (see, e.g., Culver, HUMAN GENE THERAPY, MaryAnn Liebert, Inc., Publishers, New York. pp. 70-71 (1994)). In one embodiment, the siNA molecules of the invention and formulations or compositions thereof are administered to a cell, subject, or organism as is described herein and as is generally known in the art.

1. In Vivo Administration

In any of the methods of treatment of the invention, the siNA can be administered to the subject systemically as described herein or otherwise known in the art, either alone as a monotherapy or in combination with additional therapies described herein or as are known in the art. Systemic administration can include, for example, pulmonary (inhalation, nebulization etc.) intravenous, subcutaneous, intramuscular, catheterization, nasopharangeal, transdermal, or oral/gastrointestinal administration as is generally known in the art.

In any of the methods of treatment or prevention of the invention, the siNA can be administered to the subject locally or to local tissues as described herein or otherwise known in the art, either alone as a monotherapy or in combination with additional therapies as are known in the art. Local administration can include, for example, inhalation, nebulization, catheterization, implantation, direct injection, dermal/transdermal application, patches, stenting, ear/eye drops, or portal vein administration to relevant tissues, or any other local administration technique, method or procedure, as is generally known in the art.

In one embodiment, the siNA molecules of the invention and formulations or compositions thereof are administered to the liver as is generally known in the art (see for example Wen et al., 2004, *World J. Gastroenterol.*, 10, 244-9; Murao et al., 2002, *Pharm Res.*, 19, 1808-14; Liu et al., 2003, *gene Ther.*, 10, 180-7; Hong et al., 2003, *J Pharm Pharmacol.*, 54, 51-8; Herrmann et al., 2004, *Arch Virol.*, 149, 1611-7; and Matsuno et al., 2003, *gene Ther.*, 10, 1559-66).

In one embodiment, the invention features the use of methods to deliver the siNA molecules of the instant invention to hematopoietic cells, including monocytes and lymphocytes. These methods are described in detail by Hartmann et al., 1998, *J. Phamacol. Exp. Ther.*, 285(2), 920-928; Kronenwett et al., 1998, *Blood*, 91(3), 852-862; Filion and Phillips, 1997, *Biochim. Biophys. Acta.*, 1329(2), 345-356; Ma and Wei, 1996, *Leuk. Res.*, 20(11/12), 925-930; and Bongartz et al., 1994, *Nucleic Acids Research*, 22(22), 4681-8.

In one embodiment, the siNA molecules of the invention and formulations or compositions thereof are administered directly or topically (e.g., locally) to the dermis or follicles as is generally known in the art (see for example Brand, 2001, *Curr. Opin. Mol. Ther.*, 3, 244-8; Regnier et al., 1998, *J. Drug Target*, 5, 275-89; Kanikkannan, 2002, *BioDrugs*, 16, 339-47; Wraight et al., 2001, *Pharmacol. Ther.*, 90, 89-104; and Preat and Dujardin, 2001, STP PharmaSciences, 11, 57-68). In one embodiment, the siNA molecules of the invention and formulations or compositions thereof are administered directly or topically using a hydroalcoholic gel formulation comprising an alcohol (e.g., ethanol or isopropanol), water, and optionally including additional agents such isopropyl myristate and carbomer 980. In other embodiments, the siNA are formulated to be administered topically to the nasal cavity. Topical preparations can be administered by one or more applications per day to the affected area; over skin areas occlusive dressings can advantageously be used. Continuous or prolonged delivery can be achieved by an adhesive reservoir system.

In one embodiment, an siNA molecule of the invention is administered iontophoretically, for example to a particular organ or compartment (e.g., the eye, back of the eye, heart, liver, kidney, bladder, prostate, tumor, CNS etc.). Non-limiting examples of iontophoretic delivery are described in, for example, WO 03/043689 and WO 03/030989, which are incorporated by reference in their entireties herein.

In one embodiment, the siNA molecules of the invention and formulations or compositions thereof are administered to the lung as is described herein and as is generally known in the art. In another embodiment, the siNA molecules of the invention and formulations or compositions thereof are administered to lung tissues and cells as is described in U.S. Patent Publication Nos. 2006/0062758; 2006/0014289; and 2004/0077540.

2. Aerosols and Delivery Devices a. Aerosol Formulations

The compositions of the present invention, either alone or in combination with other suitable components, can be made into aerosol formulations (i.e., they can be "nebulized") to be administered via inhalation (e.g., intranasally or intratracheally) (see, Brigham et al., *Am. J. Sci.*, 298:278 (1989)). Aerosol formulations can be placed into pressurized acceptable propellants, such as dichlorodifluoromethane, propane, nitrogen, and the like.

In one embodiment, the siNA molecules of the invention and formulations thereof are administered via pulmonary delivery, such as by inhalation of an aerosol or spray dried formulation administered by an inhalation device or nebulizer, providing rapid local uptake of the nucleic acid molecules into relevant pulmonary tissues. Solid particulate compositions containing respirable dry particles of micronized nucleic acid compositions can be prepared by grinding dried or lyophilized nucleic acid compositions, and then passing the micronized composition through, for example, a 400 mesh screen to break up or separate out large agglomerates. A solid particulate composition comprising the siNA compositions of the invention can optionally contain a dispersant which serves to facilitate the formation of an aerosol as well as other therapeutic compounds. A suitable dispersant is lactose, which can be blended with the nucleic acid compound in any suitable ratio, such as a 1 to 1 ratio by weight.

Spray compositions comprising siNA molecules or compositions of the invention can, for example, be formulated as aqueous solutions or suspensions or as aerosols delivered from pressurized packs, such as a metered dose inhaler, with the use of a suitable liquefied propellant. In one embodiment, aerosol compositions of the invention suitable for inhalation can be either a suspension or a solution and generally contain an siNA molecule comprising at least a 15 nucleotide sequence of SEQ ID NO: 1, SEQ ID NO: 452, SEQ ID NO: 2, SEQ ID NO: 453, SEQ ID NO: 3, SEQ ID NO: 454, SEQ ID NO: 4, or SEQ ID NO:455; or formula (A), and a suitable propellant such as a fluorocarbon or hydrogen-containing chlorofluorocarbon or mixtures thereof, particularly hydrofluoroalkanes, especially 1,1,1,2-tetrafluoroethane, 1,1,1,2,3,3,3-heptafluoro-n-propane or a mixture thereof. The aerosol composition can optionally contain additional formulation excipients well known in the art such as surfactants. Non-limiting examples include oleic acid, lecithin or an oligolactic acid or derivative such as those described in WO94/21229 and WO98/34596 and co-solvents for example ethanol. In one embodiment a pharmaceutical aerosol formulation of the invention comprising a compound of the invention and a fluorocarbon or hydrogen-containing chlorofluorocarbon or mixtures thereof as propellant, optionally in combination with a surfactant and/or a co-solvent.

The aerosol formulations of the invention can be buffered by the addition of suitable buffering agents.

Aerosol formulations can include optional additives including preservatives if the formulation is not prepared sterile. Non-limiting examples include, methyl hydroxybenzoate, anti-oxidants, flavorings, volatile oils, buffering agents and emulsifiers and other formulation surfactants. In one embodiment, fluorocarbon or perfluorocarbon carriers are used to reduce degradation and provide safer biocompatible non-liquid particulate suspension compositions of the invention (e.g., siNA and/or LNP formulations thereof). In another embodiment, a device comprising a nebulizer delivers a composition of the invention (e.g., siNA and/or LNP formulations thereof) comprising fluorochemicals that are bacteriostatic thereby decreasing the potential for microbial growth in compatible devices.

Capsules and cartridges comprising the composition of the invention for use in an inhaler or insufflator, of for example gelatine, can be formulated containing a powder mix for inhalation of a compound of the invention and a suitable powder base such as lactose or starch. In one embodiment, each capsule or cartridge contains an siNA molecule comprising at least a 15 nucleotide sequence of SEQ ID NO: 1, SEQ ID NO: 452, SEQ ID NO: 2, SEQ ID NO: 453, SEQ ID NO: 3, SEQ ID NO: 454, SEQ ID NO: 4, or SEQ ID NO:455; or formula (A), and one or more excipients. In another embodiment, the compound of the invention can be presented without excipients such as lactose The aerosol compositions of the present invention can be administered into the respiratory system as a formulation including particles of respirable size, e.g. particles of a size sufficiently small to pass through the nose, mouth and larynx upon inhalation and through the bronchi and alveoli of the lungs. In general, respirable particles range from about 0.5 to 10 microns in size. In one embodiment, the particulate range can be from 1 to 5 microns. In another embodiment, the particulate range can be from 2 to 3 microns. Particles of non-respirable size which are included in the aerosol tend to deposit in the throat and be swallowed, and the quantity of non-respirable particles in the aerosol is thus minimized. For nasal administration, a particle size in the range of 10-500 um is preferred to ensure retention in the nasal cavity.

In some embodiments, an siNA composition of the invention is administered topically to the nose for example, for the treatment of rhinitis, via pressurized aerosol formulations, aqueous formulations administered to the nose by pressurized pump or by nebulization. Suitable formulations contain water as the diluent or carrier for this purpose. In certain embodiments, the aqueous formulations for administration of the composition of the invention to the lung or nose can be provided with conventional excipients such as buffering agents, tonicity modifying agents and the like.

b. Devices

The siNA molecules of the invention can be formulated and delivered as particles and/or aerosols as discussed above and dispensed from various aerosolization devices known by those of skill in the art.

Aerosols of liquid or non-liquid particles comprising an siNA molecule or formulation of the invention can be produced by any suitable means, such as with a device comprising a nebulizer (see for example U.S. Pat. No. 4,501,729) such as ultrasonic or air jet nebulizers.

Solid particle aerosols comprising an siNA molecule or formulation of the invention and surfactant can be produced with any solid particulate aerosol generator. One type of solid particle aerosol generator used with the siNA molecules of the invention is an insufflator. A second type of illustrative aerosol generator comprises a metered dose inhaler ("MDI"). MDIs containing siNA molecules or formulations taught herein can be prepared by methods of the art (for example, see Byron, above and WO96/32099).

The siNA molecules can also be formulated as a fluid formulation for delivery from a fluid dispenser, such as those described and illustrated in WO05/044354.

In certain embodiments of the invention, nebulizer devices are used in applications for conscious, spontaneously breathing subjects, and for controlled ventilated subjects of all ages. The nebulizer devices can be used for targeted topical and systemic drug delivery to the lung. In one embodiment, a device comprising a nebulizer is used to deliver an siNA molecule or formulation of the invention locally to lung or pulmonary tissues. In another embodiment, a device comprising a nebulizer is used to deliver a an siNA molecule or formulation of the invention systemically.

H. Other Applications/Uses of siNA Molecules of the Invention

The siNA molecules of the invention can also be used for diagnostic applications, research applications, and/or manufacture of medicants.

In one aspect, the invention features a method for diagnosing a disease, trait, or condition in a subject comprising administering to the subject a composition of the invention under conditions suitable for the diagnosis of the disease, trait, or condition in the subject.

In one embodiment, siNA molecules of the invention are used to down regulate or inhibit the expression of HBV proteins arising from haplotype polymorphisms that are associated with a trait, disease or condition in a subject or organism. Analysis of HBV genes, or HBV protein or RNA levels can be used to identify subjects with such polymorphisms or those subjects who are at risk of developing traits, conditions, or diseases described herein. These subjects are amenable to treatment, for example, treatment with siNA molecules of the invention and any other composition useful in treating diseases related to target gene expression. As such, analysis of HBV protein or RNA levels can be used to determine treatment type and the course of therapy in treating a subject. Monitoring of HBV protein (e.g., hepatitis B core antigen, or HbcAg), HBV surface antigen (e.g., HBsAg) or RNA levels can be used to predict treatment outcome and to determine the efficacy of compounds and compositions that modulate the level and/or activity of certain HBV proteins associated with a trait, disorder, condition, or disease.

In another embodiment, the invention comprises use of a double-stranded nucleic acid according to the invention for use in the manufacture of a medicament. In an embodiment, the medicament is for use in treating HBV infection or a condition that is mediated by the action of HBV. In one embodiment, the medicament is for use in treating HBV infection. In some embodiments, the medicament is for use in the treatment of cancer. In a particular embodiment, the compounds of the instant invention are useful for treating hepatocellular carcinoma. In one embodiment, the medicament is for use in the treatment of liver disease. In a particular embodiment, the compounds of the instant invention are useful for treating cirrhosis of the liver.

In certain embodiments, siNAs wherein at least one strand comprises at least a 15 nucleotide sequence of SEQ ID NO: 1, SEQ ID NO: 452, SEQ ID NO: 2, SEQ ID NO: 453, SEQ ID NO: 3, SEQ ID NO: 454, SEQ ID NO: 4, or SEQ ID NO:455; or formula (A), are for use in a method for treating HBV infection.

In certain embodiments, siNAs wherein at least one strand comprises at least a 15 nucleotide sequence of SEQ ID NO: 1, SEQ ID NO: 452, SEQ ID NO: 2, SEQ ID NO: 453, SEQ ID NO: 3, SEQ ID NO: 454, SEQ ID NO: 4, or SEQ ID NO:455; or formula (A), are for use in a method for treating cancer.

In certain embodiments, siNAs wherein at least one strand comprises at least a 15 nucleotide sequence of SEQ ID NO: 1, SEQ ID NO: 452, SEQ ID NO: 2, SEQ ID NO: 453, SEQ ID NO: 3, SEQ ID NO: 454, SEQ ID NO: 4, or SEQ ID NO:455; or formula (A), are for use in a method for treating liver disease.

I. Examples

The invention will now be illustrated with the following non-limiting examples. Those of skill in the art will readily recognize a variety of non-critical parameters which can be changed or modified to yield essentially the same results.

Example 1

Design, Synthesis, and Identification of siNAs Active Against HBV

HBV siNA Synthesis

A series of siNA molecules were designed, synthesized and evaluated for efficacy against HBV gene expression. HBV sequences were designed and selected by selecting all possible 19 nucleotide sequences from HBV genome serotype adw2 (Accession Number X02763) and then comparing these sequences to the genome sequences of 22 other HBV subtypes shown in Table 7. 19 nucleotide sequences having perfect matches to all 22 genomes, or perfect matches in 21 of the 22 genomes and 1 or 2 mismatches to the remaining genome, were retained. These sequences were subjected to standard filters (e.g., off-target to human genome, runs of same base, matches to human miRNA seed sequences) (See also U.S. Application No. 60/182,605 for sequence design methods and standard filters). The remaining candidates were sorted by a proprietary silencing prediction score and certain sequences were selected.

The primary criteria for design for the HBV sequences for human siNAs were (i) homology between multiple HBV genotypes and serotypes and (ii) high efficacy scores as determined by a proprietary algorithm. The target sequences of the siNAs that were selected are set forth in Table 1a (target sequences). The sense and antisense strands of the siNA sequences corresponding to the target sequences in Table 1a are set forth in Table 1b. Various chemically modified siNAs that were synthesized are set forth in Table 1c.

TABLE 1a

HBV Target Sequences, noting target sites.

| Target Sequence | Target Site | SEQ ID NO: |
|---|---|---|
| UCGUGGUGGACUUCUCUCA | 1663 | 1 |
| GUGGUGGACUUCUCUCAAU | 1665 | 2 |
| GCCGAUCCAUACUGCGGAA | 2669 | 3 |
| CCGAUCCAUACUGCGGAAC | 2670 | 4 |
| CAUCCUGCUGCUAUGCCUC | 1818 | 5 |
| UGCUGCUAUGCCUCAUCUU | 1823 | 6 |
| GGUGGACUUCUCUCAAUUU | 1667 | 7 |
| UGGUGGACUUCUCUCAAUU | 1666 | 8 |
| UAGACUCGUGGUGGACUUC | 1658 | 9 |
| UCCUCUGCCGAUCCAUACU | 2663 | 10 |
| UGCCGAUCCAUACUGCGGA | 2668 | 11 |
| UGGAUGUGUCUGCGGCGUU | 1783 | 12 |
| CGAUCCAUACUGCGGAACU | 2671 | 13 |
| CGCACCUCUCUUUACGCGG | 2934 | 14 |
| CUGCCGAUCCAUACUGCGG | 2667 | 15 |
| CGUGGUGGACUUCUCUCAA | 1664 | 16 |
| CUGCUGCUAUGCCUCAUCU | 1822 | 17 |
| CCUGCUGCUAUGCCUCAUC | 1821 | 18 |
| CUAGACUCGUGGUGGACUU | 1657 | 19 |
| UCCUGCUGCUAUGCCUCAU | 1820 | 20 |
| GACUCGUGGUGGACUUCUC | 1660 | 21 |
| AUCCAUACUGCGGAACUCC | 2673 | 22 |
| CUCUGCCGAUCCAUACUGC | 2665 | 23 |

TABLE 1a-continued

HBV Target Sequences, noting target sites.

| Target Sequence | Target Site | SEQ ID NO: |
|---|---|---|
| GAUCCAUACUGCGGAACUC | 2672 | 24 |
| GAAGAACUCCCUCGCCUCG | 567 | 25 |
| AAGCCUCCAAGCUGUGCCU | 54 | 26 |
| AGAAGAACUCCCUCGCCUC | 566 | 27 |
| GGAGUGUGGAUUCGCACUC | 455 | 28 |
| CCUCUGCCGAUCCAUACUG | 2664 | 29 |
| CAAGCCUCCAAGCUGUGCC | 53 | 30 |
| UCCAUACUGCGGAACUCCU | 2674 | 31 |
| CAGAGUCUAGACUCGUGGU | 1651 | 32 |
| AAGAAGAACUCCCUCGCCU | 565 | 33 |
| GAGUGUGGAUUCGCACUCC | 456 | 34 |
| UCUAGACUCGUGGUGGACU | 1656 | 35 |
| GCUGCUAUGCCUCAUCUUC | 1824 | 36 |
| AGUCUAGACUCGUGGUGGA | 1654 | 37 |

TABLE 1a-continued

HBV Target Sequences, noting target sites.

| Target Sequence | Target Site | SEQ ID NO: |
|---|---|---|
| CUCCUCUGCCGAUCCAUAC | 2662 | 38 |
| UGGCUCAGUUUACUAGUGC | 2077 | 39 |
| GUCUAGACUCGUGGUGGAC | 1655 | 40 |
| UUCAAGCCUCCAAGCUGUG | 51 | 41 |
| CUAUGGGAGUGGGCCUCAG | 2047 | 42 |
| CUCGUGGUGGACUUCUCUC | 1662 | 43 |
| CCUAUGGGAGUGGGCCUCA | 2046 | 44 |
| AAGAACUCCCUCGCCUCGC | 568 | 45 |
| UCUGCCGAUCCAUACUGCG | 2666 | 46 |
| AGAGUCUAGACUCGUGGUG | 1652 | 47 |
| GAAGAAGAACUCCCUCGCC | 564 | 48 |
| UCAAGCCUCCAAGCUGUGC | 52 | 49 |
| AGCCUCCAAGCUGUGCCUU | 55 | 50 |
| AGACUCGUGGUGGACUUCU | 1659 | 51 |

TABLE 1b

Various HBV siNA sense and antisense sequences corresponding to the identified target sequences in Table 1a.

| Target Site | SEQ ID NO: | Sense Sequence | Antisense Sequence | SEQ ID NO: |
|---|---|---|---|---|
| 1663 | 1 | UCGUGGUGGACUUCUCUCA | UGAGAGAAGUCCACCACGA | 452 |
| 1665 | 2 | GUGGUGGACUUCUCUCAAU | AUUGAGAGAAGUCCACCAC | 453 |
| 2669 | 3 | GCCGAUCCAUACUGCGGAA | UUCCGCAGUAUGGAUCGGC | 454 |
| 2670 | 4 | CCGAUCCAUACUGCGGAAC | GUUCCGCAGUAUGGAUCGG | 455 |
| 1818 | 5 | CAUCCUGCUGCUAUGCCUC | GAGGCAUAGCAGCAGGAUG | 456 |
| 1823 | 6 | UGCUGCUAUGCCUCAUCUU | AAGAUGAGGCAUAGCAGCA | 457 |
| 1667 | 7 | GGUGGACUUCUCUCAAUUU | AAAUUGAGAGAAGUCCACC | 458 |
| 1666 | 8 | UGGUGGACUUCUCUCAAUU | AAUUGAGAGAAGUCCACCA | 459 |
| 1658 | 9 | UAGACUCGUGGUGGACUUC | GAAGUCCACCACGAGUCUA | 460 |
| 2663 | 10 | UCCUCUGCCGAUCCAUACU | AGUAUGGAUCGGCAGAGGA | 461 |
| 2668 | 11 | UGCCGAUCCAUACUGCGGA | UCCGCAGUAUGGAUCGGCA | 462 |
| 1783 | 12 | UGGAUGUGUCUGCGGCGUU | AACGCCGCAGACACAUCCA | 463 |
| 2671 | 13 | CGAUCCAUACUGCGGAACU | AGUUCCGCAGUAUGGAUCG | 464 |
| 2934 | 14 | CGCACCUCUCUUUACGCGG | CCGCGUAAAGAGAGGUGCG | 465 |
| 2667 | 15 | CUGCCGAUCCAUACUGCGG | CCGCAGUAUGGAUCGGCAG | 466 |
| 1664 | 16 | CGUGGUGGACUUCUCUCAA | UUGAGAGAAGUCCACCACG | 467 |
| 1822 | 17 | CUGCUGCUAUGCCUCAUCU | AGAUGAGGCAUAGCAGCAG | 468 |

TABLE 1b-continued

Various HBV siNA sense and antisense sequences corresponding to the identified target sequences in Table 1a.

| Target Site | SEQ ID NO: | Sense Sequence | Antisense Sequence | SEQ ID NO: |
|---|---|---|---|---|
| 1821 | 18 | CCUGCUGCUAUGCCUCAUC | GAUGAGGCAUAGCAGCAGG | 469 |
| 1657 | 19 | CUAGACUCGUGGUGGACUU | AAGUCCACCACGAGUCUAG | 470 |
| 1820 | 20 | UCCUGCUGCUAUGCCUCAU | AUGAGGCAUAGCAGCAGGA | 471 |
| 1660 | 21 | GACUCGUGGUGGACUUCUC | GAGAAGUCCACCACGAGUC | 472 |
| 2673 | 22 | AUCCAUACUGCGGAACUCC | GGAGUUCCGCAGUAUGGAU | 473 |
| 2665 | 23 | CUCUGCCGAUCCAUACUGC | GCAGUAUGGAUCGGCAGAG | 474 |
| 2672 | 24 | GAUCCAUACUGCGGAACUC | GAGUUCCGCAGUAUGGAUC | 475 |
| 567 | 25 | GAAGAACUCCCUCGCCUCG | CGAGGCGAGGGAGUUCUUC | 476 |
| 54 | 26 | AAGCCUCCAAGCUGUGCCU | AGGCACAGCUUGGAGGCUU | 477 |
| 566 | 27 | AGAAGAACUCCCUCGCCUC | GAGGCGAGGGAGUUCUUCU | 478 |
| 455 | 28 | GGAGUGUGGAUUCGCACUC | GAGUGCGAAUCCACACUCC | 479 |
| 2664 | 29 | CCUCUGCCGAUCCAUACUG | CAGUAUGGAUCGGCAGAGG | 480 |
| 53 | 30 | CAAGCCUCCAAGCUGUGCC | GGCACAGCUUGGAGGCUUG | 481 |
| 2674 | 31 | UCCAUACUGCGGAACUCCU | AGGAGUUCCGCAGUAUGGA | 482 |
| 1651 | 32 | CAGAGUCUAGACUCGUGGU | ACCACGAGUCUAGACUCUG | 483 |
| 565 | 33 | AAGAAGAACUCCCUCGCCU | AGGCGAGGGAGUUCUUCUU | 484 |
| 456 | 34 | GAGUGUGGAUUCGCACUCC | GGAGUGCGAAUCCACACUC | 485 |
| 1656 | 35 | UCUAGACUCGUGGUGGACU | AGUCCACCACGAGUCUAGA | 486 |
| 1824 | 36 | GCUGCUAUGCCUCAUCUUC | GAAGAUGAGGCAUAGCAGC | 487 |
| 1654 | 37 | AGUCUAGACUCGUGGUGGA | UCCACCACGAGUCUAGACU | 488 |
| 2662 | 38 | CUCCUCUGCCGAUCCAUAC | GUAUGGAUCGGCAGAGGAG | 489 |
| 2077 | 39 | UGGCUCAGUUUACUAGUGC | GCACUAGUAAACUGAGCCA | 490 |
| 1655 | 40 | GUCUAGACUCGUGGUGGAC | GUCCACCACGAGUCUAGAC | 491 |
| 51 | 41 | UUCAAGCCUCCAAGCUGUG | CACAGCUUGGAGGCUUGAA | 492 |
| 2047 | 42 | CUAUGGGAGUGGGCCUCAG | CUGAGGCCCACUCCCAUAG | 493 |
| 1662 | 43 | CUCGUGGUGGACUUCUCUC | GAGAGAAGUCCACCACGAG | 494 |
| 2046 | 44 | CCUAUGGGAGUGGGCCUCA | UGAGGCCCACUCCCAUAGG | 495 |
| 568 | 45 | AAGAACUCCCUCGCCUCGC | GCGAGGCGAGGGAGUUCUU | 496 |
| 2666 | 46 | UCUGCCGAUCCAUACUGCG | CGCAGUAUGGAUCGGCAGA | 497 |
| 1652 | 47 | AGAGUCUAGACUCGUGGUG | CACCACGAGUCUAGACUCU | 498 |
| 564 | 48 | GAAGAAGAACUCCCUCGCC | GGCGAGGGAGUUCUUCUUC | 499 |
| 52 | 49 | UCAAGCCUCCAAGCUGUGC | GCACAGCUUGGAGGCUUGA | 500 |
| 55 | 50 | AGCCUCCAAGCUGUGCCUU | AAGGCACAGCUUGGAGGCU | 501 |
| 1659 | 51 | AGACUCGUGGUGGACUUCU | AGAAGUCCACCACGAGUCU | 502 |

For each oligonucleotide of a target sequence, the two individual, complementary strands of the siNA were synthesized separately using solid phase synthesis, then purified separately by reversed phase solid phase extraction (SPE).

The complementary strands were annealed to form the double strand (duplex) and delivered in the desired concentration and buffer of choice.

Briefly, the single strand oligonucleotides were synthesized using phosphoramidite chemistry on an automated solid-phase synthesizer, using procedures as are generally known in the art (see for example U.S. application Ser. No. 12/064,014). A synthesis column was packed with solid support derivatized with the first nucleoside residue (natural or chemically modified). Synthesis was initiated by detritylation of the acid labile 5'-O-dimethoxytrityl group to release the 5'-hydroxyl. A suitably protected phosphoramidite and a suitable activator in acetonitrile were delivered simultaneously to the synthesis column resulting in coupling of the amidite to the 5'-hydroxyl. The column was then washed with a solvent, such as acetonitrile. An oxidizing solution, such as an iodine solution was pumped through the column to oxidize the phosphite triester linkage P(III) to its phosphotriester P(V) analog. Unreacted 5'-hydroxyl groups were capped using reagents such as acetic anhydride in the presence of 2,6-lutidine and N-methylimidazole. The elongation cycle was resumed with the detritylation step for the next phosphoramidite incorporation. This process was repeated until the desired sequence was synthesized. The synthesis concluded with the final 5'-terminus protecting group (trityl or 5'-O-dimethoxytrityl).

Upon completion of the synthesis, the solid-support and associated oligonucleotide were dried under argon pressure or vacuum. Aqueous base was added and the mixture was heated to effect cleavage of the succinyl linkage, removal of the cyanoethyl phosphate protecting group, and deprotection of the exocyclic amine protection.

The following process was performed on single strands that do not contain ribonucleotides. After treating the solid support with the aqueous base, the mixture was filtered to separate the solid support from the deprotected crude synthesis material. The solid support was then rinsed with water, which is combined with the filtrate. The resultant basic solution allows for retention of the 5'-O-dimethoxytrityl group to remain on the 5' terminal position (trityl-on).

For single strands that contain ribonucleotides, the following process was performed. After treating the solid support with the aqueous base, the mixture was filtered to separate the solid support from the deprotected crude synthesis material. The solid support was then rinsed with dimethylsulfoxide (DMSO), which was combined with the filtrate. Fluoride reagent, such as triethylamine trihydrofluoride, was added to the mixture, and the solution was heated. The reaction was quenched with suitable buffer to provide a solution of crude single strand with the 5'-O-dimethoxytrityl group on the final 5' terminal position.

The trityl-on solution of each crude single strand was purified using chromatographic purification, such as SPE RPC purification. The hydrophobic nature of the trityl group permits stronger retention of the desired full-length oligo than the non-tritylated truncated failure sequences. The failure sequences were selectively washed from the resin with a suitable solvent, such as low percent acetonitrile. Retained oligonucleotides were then detritylated on-column with trifluoroacetic acid to remove the acid-labile trityl group. Residual acid was washed from the column, a salt exchange was performed, and a final desalting of the material commenced.

The full-length oligo was recovered in a purified form with an aqueous-organic solvent. The final product was then analyzed for purity (HPLC), identity (Maldi-TOF MS), and yield (UV $A_{260}$). The oligos were dried via lyophilization or vacuum condensation.

Annealing:

Based on the analysis of the product, the dried oligos were dissolved in appropriate buffers followed by mixing equal molar amounts (calculated using the theoretical extinction coefficient) of the sense and antisense oligonucleotide strands. The solution was then analyzed for purity of duplex by chromatographic methods and desired final concentration. If the analysis indicated an excess of either strand, then the additional non-excess strand was titrated until duplexing was complete. When analysis indicated that the target product purity has been achieved the material was delivered and ready for use.

Below is a table showing various modified siNAs synthesized using this protocol or that can be synthesized using this protocol or using methods known in the art.

TABLE 1c

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008351268-000C | 1663 | 1 | UCGUGGUGGACUUCUCUCA B | UCGUGGUGGACUUCUCUCATT B | 52 |
| R-008351268-000C | 1663 | 1 | UCGUGGUGGACUUCUCUCA | UGAGAGAAGUCCACCACGAUU | 53 |
| R-008351278-000V | 1665 | 2 | GUGGUGGACUUCUCUCAAU B | GuGGuGGAcuucucucAAuTT B | 54 |
| R-008351278-000V | 1665 | 2 | GUGGUGGACUUCUCUCAAU | AUUGAGAGAAGuccAccAcUU | 55 |
| R-008351342-000A | 2669 | 3 | GCCGAUCCAUACUGCGGAA B | GCCGAUCCAUACUGCGGAATT B | 56 |
| R-008351342-000A | 2669 | 3 | GCCGAUCCAUACUGCGGAA | UUCCGCAGUAUGGAUCGGCUU | 57 |
| R-008351172-000H | 1665 | 2 | GUGGUGGACUUCUCUCAAU B | GUGGUGGACUUCUCUCAAUTT B | 58 |
| R-008351172-000H | 1665 | 2 | GUGGUGGACUUCUCUCAAU | AUUGAGAGAAGUCCACCACUU | 59 |
| R-008351362-000K | 2670 | 4 | CCGAUCCAUACUGCGGAAC B | ccGAuccAuAcuGcGGAAcTT B | 60 |
| R-008351362-000K | 2670 | 4 | CCGAUCCAUACUGCGGAAC | GUUccGcAGuAuGGAucGGUU | 61 |

TABLE 1c-continued

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008351389-000F | 1818 | 5 | CAUCCUGCUGCUAUGCCUC B | CAUCCUGCUGCUAUGCCUCTT B | 62 |
| R-008351389-000F | 1818 | 5 | CAUCCUGCUGCUAUGCCUC | GAGGCAUAGCAGCAGGAUGUU | 63 |
| R-008351306-000R | 1823 | 6 | UGCUGCUAUGCCUCAUCUU B | UGCUGCUAUGCCUCAUCUUTT B | 64 |
| R-008351306-000R | 1823 | 6 | UGCUGCUAUGCCUCAUCUU | AAGAUGAGGCAUAGCAGCAUU | 65 |
| R-008351372-000C | 1667 | 7 | GGUGGACUUCUCUCAAUUU B | *GGuGGAcuucucucAAuuu*TT B | 66 |
| R-008351372-000C | 1667 | 7 | GGUGGACUUCUCUCAAUUU | AAAuuGAGAGAAGuccAccUU | 67 |
| R-008351317-000S | 1666 | 8 | UGGUGGACUUCUCUCAAUU B | uGGuGGAcuucucucAAuuTT B | 68 |
| R-008351317-000S | 1666 | 8 | UGGUGGACUUCUCUCAAUU | AAUuGAGAGAAGuccAccAUU | 69 |
| R-008351210-000W | 1658 | 9 | UAGACUCGUGGUGGACUUC B | UAGACUCGUGGUGGACUUCTT B | 70 |
| R-008351210-000W | 1658 | 9 | UAGACUCGUGGUGGACUUC | GAAGUCCACCACGAGUCUAUU | 71 |
| R-008351329-000B | 2663 | 10 | UCCUCUGCCGAUCCAUACU B | UCCUCUGCCGAUCCAUACUTT B | 72 |
| R-008351329-000B | 2663 | 10 | UCCUCUGCCGAUCCAUACU | AGUAUGGAUCGGCAGAGGAUU | 73 |
| R-008351350-000A | 1658 | 9 | UAGACUCGUGGUGGACUUC B | uAGAcucGuGGuGGAcuucTT B | 74 |
| R-008351350-000A | 1658 | 9 | UAGACUCGUGGUGGACUUC | GAAGuccAccAcGAGucuAUU | 75 |
| R-008351303-000P | 2668 | 11 | UGCCGAUCCAUACUGCGGA B | UGCCGAUCCAUACUGCGGATT B | 76 |
| R-008351303-000P | 2668 | 11 | UGCCGAUCCAUACUGCGGA | UCCGCAGUAUGGAUCGGCAUU | 77 |
| R-008351229-000S | 1783 | 12 | UGGAUGUGUCUGCGGCGUU B | UGGAUGUGUCUGCGGCGUUTT B | 78 |
| R-008351229-000S | 1783 | 12 | UGGAUGUGUCUGCGGCGUU | AACGCCGCAGACACAUCCAUU | 79 |
| R-008351386-000E | 2671 | 13 | CGAUCCAUACUGCGGAACU B | CGAUCCAUACUGCGGAACUTT B | 80 |
| R-008351386-000E | 2671 | 13 | CGAUCCAUACUGCGGAACU | AGUUCCGCAGUAUGGAUCGUU | 81 |
| R-008351300-000N | 2934 | 14 | CGCACCUCUCUUUACGCGG B | CGCACCUCUCUUUACGCGGTT B | 82 |
| R-008351300-000N | 2934 | 14 | CGCACCUCUCUUUACGCGG | CCGCGUAAAGAGAGGUGCGUU | 83 |
| R-008351263-000J | 2667 | 15 | CUGCCGAUCCAUACUGCGG B | CUGCCGAUCCAUACUGCGGTT B | 84 |
| R-008351263-000J | 2667 | 15 | CUGCCGAUCCAUACUGCGG | CCGCAGUAUGGAUCGGCAGUU | 85 |
| R-008351190-000A | 1783 | 12 | UGGAUGUGUCUGCGGCGUU B | uGGAuGuGucuGcGGcGuuTT B | 86 |
| R-008351190-000A | 1783 | 12 | UGGAUGUGUCUGCGGCGUU | AACGccGcAGAcAcAuccAUU | 87 |
| R-008351326-000A | 1666 | 8 | UGGUGGACUUCUCUCAAUU B | UGGUGGACUUCUCUCAAUUTT B | 88 |
| R-008351326-000A | 1666 | 8 | UGGUGGACUUCUCUCAAUU | AAUUGAGAGAAGUCCACCAUU | 89 |
| R-008351260-000H | 1664 | 16 | CGUGGUGGACUUCUCUCAA B | CGUGGUGGACUUCUCUCAATT B | 90 |
| R-008351260-000H | 1664 | 16 | CGUGGUGGACUUCUCUCAA | UUGAGAGAAGUCCACCACGUU | 91 |
| R-008351195-000U | 1822 | 17 | CUGCUGCUAUGCCUCAUCU B | CUGCUGCUAUGCCUCAUCUTT B | 92 |
| R-008351195-000U | 1822 | 17 | CUGCUGCUAUGCCUCAUCU | AGAUGAGGCAUAGCAGCAGUU | 93 |
| R-008351323-000Z | 1821 | 18 | CCUGCUGCUAUGCCUCAUC B | CCUGCUGCUAUGCCUCAUCTT B | 94 |
| R-008351323-000Z | 1821 | 18 | CCUGCUGCUAUGCCUCAUC | GAUGAGGCAUAGCAGCAGGUU | 95 |
| R-008351367-000D | 1667 | 7 | GGUGGACUUCUCUCAAUUU B | GGUGGACUUCUCUCAAUUUTT B | 96 |
| R-008351367-000D | 1667 | 7 | GGUGGACUUCUCUCAAUUU | AAAUUGAGAGAAGUCCACCUU | 97 |

TABLE 1c-continued

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008351251-000Z | 1657 | 19 | CUAGACUCGUGGUGGACUU B | cuAGAcucGuGGuGGAcuuTT B | 98 |
| R-008351251-000Z | 1657 | 19 | CUAGACUCGUGGUGGACUU | AAGuccAccAcGAGucuAGUU | 99 |
| R-008351240-000Y | 1820 | 20 | UCCUGCUGCUAUGCCUCAU B | UCCUGCUGCUAUGCCUCAUTT B | 100 |
| R-008351240-000Y | 1820 | 20 | UCCUGCUGCUAUGCCUCAU | AUGAGGCAUAGCAGCAGGAUU | 101 |
| R-008351178-000K | 2668 | 11 | UGCCGAUCCAUACUGCGGA B | uGccGAuccAuAcuGcGGATT B | 102 |
| R-008351178-000K | 2668 | 11 | UGCCGAUCCAUACUGCGGA | UCCGcAGuAuGGAucGGcAUU | 103 |
| R-008351353-000B | 1657 | 19 | CUAGACUCGUGGUGGACUU B | CUAGACUCGUGGUGGACUUTT B | 104 |
| R-008351353-000B | 1657 | 19 | CUAGACUCGUGGUGGACUU | AAGUCCACCACGAGUCUAGUU | 105 |
| R-008351297-000W | 1660 | 21 | GACUCGUGGUGGACUUCUC B | GACUCGUGGUGGACUUCUCTT B | 106 |
| R-008351297-000W | 1660 | 21 | GACUCGUGGUGGACUUCUC | GAGAAGUCCACCACGAGUCUU | 107 |
| R-008351175-000J | 2673 | 22 | AUCCAUACUGCGGAACUCC B | AuccAuAcuGcGGAAcuccTT B | 108 |
| R-008351175-000J | 2673 | 22 | AUCCAUACUGCGGAACUCC | GGAGuuccGcAGuAuGGAuUU | 109 |
| R-008351181-000S | 2665 | 23 | CUCUGCCGAUCCAUACUGC B | cucuGccGAuccAuAcuGcTT B | 110 |
| R-008351181-000S | 2665 | 23 | CUCUGCCGAUCCAUACUGC | GCAGuAuGGAucGGcAGAGUU | 111 |
| R-008351184-000T | 2672 | 24 | GAUCCAUACUGCGGAACUC B | GAUCCAUACUGCGGAACUCTT B | 112 |
| R-008351184-000T | 2672 | 24 | GAUCCAUACUGCGGAACUC | GAGUUCCGCAGUAUGGAUCUU | 113 |
| R-008351187-000U | 567 | 25 | GAAGAACUCCCUCGCCUCG B | GAAGAACUCCCUCGCCUCGTT B | 114 |
| R-008351187-000U | 567 | 25 | GAAGAACUCCCUCGCCUCG | CGAGGCGAGGGAGUUCUUCUU | 115 |
| R-008351192-000T | 54 | 26 | AAGCCUCCAAGCUGUGCCU B | AAGccuccAAGcuGuGccuTT B | 116 |
| R-008351192-000T | 54 | 26 | AAGCCUCCAAGCUGUGCCU | AGGcAcAGcuuGGAGGcuuUU | 117 |
| R-008351198-000V | 566 | 27 | AGAAGAACUCCCUCGCCUC B | AGAAGAACUCCCUCGCCUCTT B | 118 |
| R-008351198-000V | 566 | 27 | AGAAGAACUCCCUCGCCUC | GAGGCGAGGGAGUUCUUCUUU | 119 |
| R-008351201-000M | 2671 | 13 | CGAUCCAUACUGCGGAACU B | cGAuccAuAcuGcGGAAcuTT B | 120 |
| R-008351201-000M | 2671 | 13 | CGAUCCAUACUGCGGAACU | AGUuccGcAGuAuGGAucGUU | 121 |
| R-008351204-000N | 455 | 28 | GGAGUGUGGAUUCGCACUC B | GGAGUGUGGAUUCGCACUCTT B | 122 |
| R-008351204-000N | 455 | 28 | GGAGUGUGGAUUCGCACUC | GAGUGCGAAUCCACACUCCUU | 123 |
| R-008351207-000P | 2664 | 29 | CCUCUGCCGAUCCAUACUG B | ccucuGccGAuccAuAcuGTT B | 124 |
| R-008351207-000P | 2664 | 29 | CCUCUGCCGAUCCAUACUG | CAGuAuGGAucGGcAGAGGUU | 125 |
| R-008351212-000N | 53 | 30 | CAAGCCUCCAAGCUGUGCC B | cAAGccuccAAGcuGuGccTT B | 126 |
| R-008351212-000N | 53 | 30 | CAAGCCUCCAAGCUGUGCC | GGcAcAGcuuGGAGGcuuGUU | 127 |
| R-008351215-000P | 2674 | 31 | UCCAUACUGCGGAACUCCU B | UCCAUACUGCGGAACUCCUTT B | 128 |
| R-008351215-000P | 2674 | 31 | UCCAUACUGCGGAACUCCU | AGGAGUUCCGCAGUAUGGAUU | 129 |
| R-008351218-000R | 1651 | 32 | CAGAGUCUAGACUCGUGGU B | CAGAGUCUAGACUCGUGGUTT B | 130 |
| R-008351218-000R | 1651 | 32 | CAGAGUCUAGACUCGUGGU | ACCACGAGUCUAGACUCUGUU | 131 |
| R-008351220-000N | 565 | 33 | AAGAAGAACUCCCUCGCCU B | AAGAAGAAcucccucGccuTT B | 132 |
| R-008351220-000N | 565 | 33 | AAGAAGAACUCCCUCGCCU | AGGcGAGGGAGuucuucuuUU | 133 |

TABLE 1c-continued

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008351223-000P | 456 | 34 | GAGUGUGGAUUCGCACUCC B | GAGUGUGGAUUCGCACUCCTT B | 134 |
| R-008351223-000P | 456 | 34 | GAGUGUGGAUUCGCACUCC | GGAGUGCGAAUCCACACUCUU | 135 |
| R-008351226-000R | 1656 | 35 | UCUAGACUCGUGGUGGACU B | UCUAGACUCGUGGUGGACUTT B | 136 |
| R-008351226-000R | 1656 | 35 | UCUAGACUCGUGGUGGACU | AGUCCACCACGAGUCUAGAUU | 137 |
| R-008351232-000Y | 2663 | 10 | UCCUCUGCCGAUCCAUACU | uccucuGccGAuccAuAcuTT B | 138 |
| R-008351232-000Y | 2663 | 10 | UCCUCUGCCGAUCCAUACU | AGUAuGGAucGGcAGAGGAUU | 139 |
| R-008351235-000Z | 53 | 30 | CAAGCCUCCAAGCUGUGCC B | CAAGCCUCCAAGCUGUGCCTT B | 140 |
| R-008351235-000Z | 53 | 30 | CAAGCCUCCAAGCUGUGCC | GGCACAGCUUGGAGGCUUGUU | 141 |
| R-008351237-000S | 1821 | 18 | CCUGCUGCUAUGCCUCAUC B | ccuGcuGcuAuGccucAucTT B | 142 |
| R-008351237-000S | 1821 | 18 | CCUGCUGCUAUGCCUCAUC | GAUGAGGcAuAGcAGcAGGUU | 143 |
| R-008351243-000Z | 2665 | 23 | CUCUGCCGAUCCAUACUGC B | CUCUGCCGAUCCAUACUGCTT B | 144 |
| R-008351243-000Z | 2665 | 23 | CUCUGCCGAUCCAUACUGC | GCAGUAUGGAUCGGCAGAGUU | 145 |
| R-008351246-000A | 1651 | 32 | CAGAGUCUAGACUCGUGGU B | cAGAGucuAGAcucGuGGuTT B | 146 |
| R-008351246-000A | 1651 | 32 | CAGAGUCUAGACUCGUGGU | ACCAcGAGucuAGAcucuGUU | 147 |
| R-008351248-000T | 1824 | 36 | GCUGCUAUGCCUCAUCUUC B | GcuGcuAuGccucAucuucTT B | 148 |
| R-008351248-000T | 1824 | 36 | GCUGCUAUGCCUCAUCUUC | GAAGAuGAGGcAuAGcAGcUU | 149 |
| R-008351254-000A | 2664 | 29 | CCUCUGCCGAUCCAUACUG B | CCUCUGCCGAUCCAUACUGTT B | 150 |
| R-008351254-000A | 2664 | 29 | CCUCUGCCGAUCCAUACUG | CAGUAUGGAUCGGCAGAGGUU | 151 |
| R-008351257-000B | 1656 | 35 | UCUAGACUCGUGGUGGACU B | ucuAGAcucGuGGuGGAcuTT B | 152 |
| R-008351257-000B | 1656 | 35 | UCUAGACUCGUGGUGGACU | AGUccAccAcGAGucuAGAUU | 153 |
| R-008351266-000K | 1818 | 5 | CAUCCUGCUGCUAUGCCUC B | cAuccuGcuGcuAuGccucTT B | 154 |
| R-008351266-000K | 1818 | 5 | CAUCCUGCUGCUAUGCCUC | GAGGcAuAGcAGcAGGAuGUU | 155 |
| R-008351271-000J | 1654 | 37 | AGUCUAGACUCGUGGUGGA B | AGucuAGAcucGuGGuGGATT B | 156 |
| R-008351271-000J | 1654 | 37 | AGUCUAGACUCGUGGUGGA | UCCAccAcGAGucuAGAcuUU | 157 |
| R-008351274-000K | 455 | 28 | GGAGUGUGGAUUCGCACUC B | GGAGuGuGGAuucGcAcucTT B | 158 |
| R-008351274-000K | 455 | 28 | GGAGUGUGGAUUCGCACUC | GAGuGcGAAuccAcAcuccUU | 159 |
| R-008351276-000C | 1823 | 6 | UGCUGCUAUGCCUCAUCUU B | uGcuGcuAuGccucAucuuTT B | 160 |
| R-008351276-000C | 1823 | 6 | UGCUGCUAUGCCUCAUCUU | AAGAuGAGGcAuAGcAGcAUU | 161 |
| R-008351281-000B | 2674 | 31 | UCCAUACUGCGGAACUCCU B | uccAuAcuGcGGAAcuccuTT B | 162 |
| R-008351281-000B | 2674 | 31 | UCCAUACUGCGGAACUCCU | AGGAGuuccGcAGuAuGGAUU | 163 |
| R-008351284-000C | 2662 | 38 | CUCCUCUGCCGAUCCAUAC B | CUCCUCUGCCGAUCCAUACTT B | 164 |
| R-008351284-000C | 2662 | 38 | CUCCUCUGCCGAUCCAUAC | GUAUGGAUCGGCAGAGGAGUU | 165 |
| R-008351287-000D | 2672 | 24 | GAUCCAUACUGCGGAACUC B | GAuccAuAcuGcGGAAcucTT B | 166 |
| R-008351287-000D | 2672 | 24 | GAUCCAUACUGCGGAACUC | GAGuuccGcAGuAuGGAucUU | 167 |
| R-008351290-000K | 567 | 25 | GAAGAACUCCCUCGCCUCG B | GAAGAAcucccucGccucGTT B | 168 |
| R-008351290-000K | 567 | 25 | GAAGAACUCCCUCGCCUCG | CGAGGcGAGGGAGuucuucUU | 169 |

TABLE 1c-continued

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008351292-000C | 1663 | 1 | UCGUGGUGGACUUCUCUCA | ucGuGGuGGAcuucucucATT B | 170 |
| R-008351292-000C | 1663 | 1 | UCGUGGUGGACUUCUCUCA | UGAGAGAAGuccAccAcGAUU | 171 |
| R-008351294-000V | 1820 | 20 | UCCUGCUGCUAUGCCUCAU | uccuGcuGcuAuGccucAuTT B | 172 |
| R-008351294-000V | 1820 | 20 | UCCUGCUGCUAUGCCUCAU | AUGAGGcAuAGcAGcAGGAUU | 173 |
| R-008351309-000S | 2673 | 22 | AUCCAUACUGCGGAACUCC | AUCCAUACUGCGGAACUCCTT B | 174 |
| R-008351309-000S | 2673 | 22 | AUCCAUACUGCGGAACUCC | GGAGUUCCGCAGUAUGGAUU | 175 |
| R-008351312-000Y | 2077 | 39 | UGGCUCAGUUUACUAGUGC | UGGCUCAGUUUACUAGUGCTT B | 176 |
| R-008351312-000Y | 2077 | 39 | UGGCUCAGUUUACUAGUGC | GCACUAGUAAACUGAGCCAUU | 177 |
| R-008351315-000Z | 54 | 26 | AAGCCUCCAAGCUGUGCCU | AAGCCUCCAAGCUGUGCCUTT B | 178 |
| R-008351315-000Z | 54 | 26 | AAGCCUCCAAGCUGUGCCU | AGGCACAGCUUGGAGGCUUUU | 179 |
| R-008351320-000Y | 566 | 27 | AGAAGAACUCCCUCGCCUC | AGAAGAAcucccucGccucTT B | 180 |
| R-008351320-000Y | 566 | 27 | AGAAGAACUCCCUCGCCUC | GAGGcGAGGGAGuucuucuUU | 181 |
| R-008351332-000H | 1655 | 40 | GUCUAGACUCGUGGUGGAC | GucuAGAcucGuGGuGGAcTT B | 182 |
| R-008351332-000H | 1655 | 40 | GUCUAGACUCGUGGUGGAC | GUCcAccAcGAGucuAGAcUU | 183 |
| R-008351334-000A | 1822 | 17 | CUGCUGCUAUGCCUCAUCU | cuGcuGcuAuGccucAucuTT B | 184 |
| R-008351334-000A | 1822 | 17 | CUGCUGCUAUGCCUCAUCU | AGAuGAGGcAuAGcAGcAGUU | 185 |
| R-008351337-000B | 2667 | 15 | CUGCCGAUCCAUACUGCGG | cuGccGAuccAuAcuGcGGTT B | 186 |
| R-008351337-000B | 2667 | 15 | CUGCCGAUCCAUACUGCGG | CCGcAGuAuGGAucGGcAGUU | 187 |
| R-008351339-000U | 51 | 41 | UUCAAGCCUCCAAGCUGUG | uucAAGccuccAAGcuGuGTT B | 188 |
| R-008351339-000U | 51 | 41 | UUCAAGCCUCCAAGCUGUG | CACAGcuuGGAGGcuuGAAUU | 189 |
| R-008351345-000B | 1654 | 37 | AGUCUAGACUCGUGGUGGA | AGUCUAGACUCGUGGUGGATT B | 190 |
| R-008351345-000B | 1654 | 37 | AGUCUAGACUCGUGGUGGA | UCCACCACGAGUCUAGACUUU | 191 |
| R-008351348-000C | 1655 | 40 | GUCUAGACUCGUGGUGGAC | GUCUAGACUCGUGGUGGACTT B | 192 |
| R-008351348-000C | 1655 | 40 | GUCUAGACUCGUGGUGGAC | GUCCACCACGAGUCUAGACUU | 193 |
| R-008351356-000C | 2047 | 42 | CUAUGGGAGUGGGCCUCAG | CUAUGGGAGUGGGCCUCAGTT B | 194 |
| R-008351356-000C | 2047 | 42 | CUAUGGGAGUGGGCCUCAG | CUGAGGCCCACUCCCAUAGUU | 195 |
| R-008351359-000D | 51 | 41 | UUCAAGCCUCCAAGCUGUG | UUCAAGCCUCCAAGCUGUGTT B | 196 |
| R-008351359-000D | 51 | 41 | UUCAAGCCUCCAAGCUGUG | CACAGCUUGGAGGCUUGAAUU | 197 |
| R-008351364-000C | 1660 | 21 | GACUCGUGGUGGACUUCUC | GAcucGuGGuGGAcuucucTT B | 198 |
| R-008351364-000C | 1660 | 21 | GACUCGUGGUGGACUUCUC | GAGAAGuccAccAcGAGucUU | 199 |
| R-008351370-000K | 1824 | 36 | GCUGCUAUGCCUCAUCUUC | GCUGCUAUGCCUCAUCUUCTT B | 200 |
| R-008351370-000K | 1824 | 36 | GCUGCUAUGCCUCAUCUUC | GAAGAUGAGGCAUAGCAGCUU | 201 |
| R-008351374-000V | 1664 | 16 | CGUGGUGGACUUCUCUCAA | cGuGGuGGAcuucucucAATT B | 202 |
| R-008351374-000V | 1664 | 16 | CGUGGUGGACUUCUCUCAA | UUGAGAGAAGuccAccAcGUU | 203 |
| R-008351377-000W | 2077 | 39 | UGGCUCAGUUUACUAGUGC | uGGcucAGuuuAcuAGuGcTT B | 204 |
| R-008351377-000W | 2077 | 39 | UGGCUCAGUUUACUAGUGC | GCAcuAGuAAAcuGAGccAUU | 205 |

TABLE 1c-continued

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008351380-000C | 2662 | 38 | CUCCUCUGCCGAUCCAUAC | cuccucuGccGAuccAuAcTT B | 206 |
| R-008351380-000C | 2662 | 38 | CUCCUCUGCCGAUCCAUAC | GUAuGGAucGGcAGAGGAGUU | 207 |
| R-008351383-000D | 456 | 34 | GAGUGUGGAUUCGCACUCC | GAGuGuGGAuucGcAcuccTT B | 208 |
| R-008351383-000D | 456 | 34 | GAGUGUGGAUUCGCACUCC | GGAGuGcGAAuccAcAcucUU | 209 |
| R-008351392-000M | 2934 | 14 | CGCACCUCUCUUUACGCGG | cGcAccucucuuuAcGcGGTT B | 210 |
| R-008351392-000M | 2934 | 14 | CGCACCUCUCUUUACGCGG | CCGcGuAAAGAGAGGuGcGUU | 211 |
| R-008351395-000N | 2670 | 4 | CCGAUCCAUACUGCGGAAC | CCGAUCCAUACUGCGGAACTT B | 212 |
| R-008351395-000N | 2670 | 4 | CCGAUCCAUACUGCGGAAC | GUUCCGCAGUAUGGAUCGGUU | 213 |
| R-008351398-000P | 2047 | 42 | CUAUGGGAGUGGGCCUCAG | cuAuGGGAGuGGGccucAGTT B | 214 |
| R-008351398-000P | 2047 | 42 | CUAUGGGAGUGGGCCUCAG | CUGAGGcccAcucccAuAGUU | 215 |
| R-008351401-000G | 565 | 33 | AAGAAGAACUCCCUCGCCU | AAGAAGAACUCCCUCGCCUTT B | 216 |
| R-008351401-000G | 565 | 33 | AAGAAGAACUCCCUCGCCU | AGGCGAGGGAGUUCUUCUUUU | 217 |
| R-008351404-000H | 2669 | 3 | GCCGAUCCAUACUGCGGAA | GccGAuccAuAcuGcGGAATT B | 218 |
| R-008351404-000H | 2669 | 3 | GCCGAUCCAUACUGCGGAA | UUCcGcAGuAuGGAucGGcUU | 219 |
| R-008380305-000E | 2670 | 4 | CCGAUCCAUACUGCGGAAC | ccGAuccAuAcuGcGGAAcUsU B | 220 |
| R-008380305-000E | 2670 | 4 | CCGAUCCAUACUGCGGAAC | GUUCCGCAGUAUGGAUCGGUsU | 221 |
| R-008380308-000F | 2670 | 4 | CCGAUCCAUACUGCGGAAC | CCGAUCCAUACUGCGGAACUsU B | 222 |
| R-008380308-000F | 2670 | 4 | CCGAUCCAUACUGCGGAAC | GuuccGcAGuAuGGAucGGUsU | 223 |
| R-008380311-000M | 2669 | 3 | GCCGAUCCAUACUGCGGAA | GccGAuccAuAcuGcGGAAUsU B | 224 |
| R-008380311-000M | 2669 | 3 | GCCGAUCCAUACUGCGGAA | UUCCgCagUaUggaUCggCUsU | 225 |
| R-008380313-000E | 2669 | 3 | GCCGAUCCAUACUGCGGAA | GCCGAUCCAUACUGCGGAAUsU B | 226 |
| R-008380313-000E | 2669 | 3 | GCCGAUCCAUACUGCGGAA | UUCCgCagUaUggaUCggCUsU | 225 |
| R-008380315-000X | 2669 | 3 | GCCGAUCCAUACUGCGGAA | GccGAuccAuAcuGcGGAAUsU B | 224 |
| R-008380315-000X | 2669 | 3 | GCCGAUCCAUACUGCGGAA | UUCCgCagUaUggaUCggCUsU | 227 |
| R-008380316-000F | 2669 | 3 | GCCGAUCCAUACUGCGGAA | GCCGAUCCAUACUGCGGAAUsU B | 226 |
| R-008380316-000F | 2669 | 3 | GCCGAUCCAUACUGCGGAA | UUCCgCagUaUggaUCggCUsU | 227 |
| R-008380318-000Y | 2669 | 3 | GCCGAUCCAUACUGCGGAA | uuccGcAGuAuGGAucGGcUsU | 228 |
| R-008380318-000Y | 2669 | 3 | GCCGAUCCAUACUGCGGAA | GCCGAUCCAUACUGCGGAAUsU B | 226 |
| R-008380321-000E | 2669 | 3 | GCCGAUCCAUACUGCGGAA | GccGAuccAuAcuGcGGAAUsU B | 229 |
| R-008380321-000E | 2669 | 3 | GCCGAUCCAUACUGCGGAA | UUCcGcAGuAuGGAucGGcUsU | 230 |
| R-008380324-000F | 2669 | 3 | GCCGAUCCAUACUGCGGAA | GCCGAUCCAUACUGCGGAAUsU B | 231 |
| R-008380324-000F | 2669 | 3 | GCCGAUCCAUACUGCGGAA | UUCCGCAGUAUGGAUCGGCUsU | 232 |
| R-008380327-000G | 1665 | 2 | GUGGUGGACUUCUCUCAAU | GuGGuGGAcuucucucAAuUsU B | 233 |
| R-008380327-000G | 1665 | 2 | GUGGUGGACUUCUCUCAAU | AuuGAGAGAAGuccAccAcUsU | 234 |
| R-008380330-000N | 1665 | 2 | GUGGUGGACUUCUCUCAAU | GUGGUGGACUUCUCUCAAUUsU B | 235 |
| R-008380330-000N | 1665 | 2 | GUGGUGGACUUCUCUCAAU | AUUGAGAGAAGUCCACCACUsU | 236 |

TABLE 1c-continued

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008380333-000P | 1663 | 1 | UCGUGGUGGACUUCUCUCA | B ucGuGGuGGAcuucucucAUsU B | 237 |
| R-008380333-000P | 1663 | 1 | UCGUGGUGGACUUCUCUCA | UGAgagaagUCCaCCaCgaUsU | 238 |
| R-008380335-000G | 1663 | 1 | UCGUGGUGGACUUCUCUCA | B ucGuGGuGGAcuucucucAUsU B | 237 |
| R-008380335-000G | 1663 | 1 | UCGUGGUGGACUUCUCUCA | UGAGAGAAGuccAccAcGAUsU | 239 |
| R-008380337-000Z | 1663 | 1 | UCGUGGUGGACUUCUCUCA | B ucGuGGuGGAcuucucucAUsU B | 237 |
| R-008380337-000Z | 1663 | 1 | UCGUGGUGGACUUCUCUCA | UGAGAGAAGUCCACCACGAUsU | 240 |
| R-008380340-000F | 1663 | 1 | UCGUGGUGGACUUCUCUCA | B UCGUGGUGGACUUCUCUCAUsU B | 241 |
| R-008380340-000F | 1663 | 1 | UCGUGGUGGACUUCUCUCA | UGAgagaagUCCaCCaCgaUsU | 242 |
| R-008380343-000G | 1663 | 1 | UCGUGGUGGACUUCUCUCA | uGAGAGAAGuccAccAcGAUsU | 243 |
| R-008380343-000G | 1663 | 1 | UCGUGGUGGACUUCUCUCA | B UCGUGGUGGACUUCUCUCAUsU B | 244 |
| R-008380346-000H | 2670 | 4 | CCGAUCCAUACUGCGGAAC | B ccGAuccAuAcuGcGGAAcUsU B | 245 |
| R-008380346-000H | 2670 | 4 | CCGAUCCAUACUGCGGAAC | GUUccGcAGuAuGGAucGGUsU | 246 |
| R-008380348-000A | 2669 | 3 | GCCGAUCCAUACUGCGGAA | B GCCGAUCCAUACUGCGGAAUsU B | 247 |
| R-008380348-000A | 2669 | 3 | GCCGAUCCAUACUGCGGAA | UUCCgCagUaUggaUCggCUsU | 225 |
| R-008380349-000J | 2669 | 3 | GCCGAUCCAUACUGCGGAA | B GccGAuccAuAcuGcGGAAUsU B | 224 |
| R-008380349-000J | 2669 | 3 | GCCGAUCCAUACUGCGGAA | UUCCgcAGuAuGGAucGGcUsU | 230 |
| R-008380351-000G | 2669 | 3 | GCCGAUCCAUACUGCGGAA | B GccGAuccAuAcuGcGGAAUsU B | 224 |
| R-008380351-000G | 2669 | 3 | GCCGAUCCAUACUGCGGAA | UUCCGCAGUAUGGAUCGGCUsU | 248 |
| R-008380352-000R | 2669 | 3 | GCCGAUCCAUACUGCGGAA | B GCCGAUCCAUACUGCGGAAUsU B | 247 |
| R-008380352-000R | 2669 | 3 | GCCGAUCCAUACUGCGGAA | UUCCGCAGUAUGGAUCGGCUsU | 248 |
| R-008380353-000Z | 2669 | 3 | GCCGAUCCAUACUGCGGAA | B GCCGAUCCAUACUGCGGAAUsU B | 247 |
| R-008380353-000Z | 2669 | 3 | GCCGAUCCAUACUGCGGAA | UUCCgCagUaUggaUCggCUsU | 227 |
| R-008380354-000H | 2669 | 3 | GCCGAUCCAUACUGCGGAA | uuccGcAGuAuGGAucGGcUsU | 228 |
| R-008380354-000H | 2669 | 3 | GCCGAUCCAUACUGCGGAA | B GccGAuccAuAcuGcGGAAUsU B | 224 |
| R-008380356-000A | 2669 | 3 | GCCGAUCCAUACUGCGGAA | uuccGcAGuAuGGAucGGcUsU | 228 |
| R-008380356-000A | 2669 | 3 | GCCGAUCCAUACUGCGGAA | B GccGAuccAuAcuGcGGAAUsU B | 249 |
| R-008380359-000B | 1665 | 2 | GUGGUGGACUUCUCUCAAU | B GUGGUGGACUUCUCUCAAUUsU B | 250 |
| R-008380359-000B | 1665 | 2 | GUGGUGGACUUCUCUCAAU | AUUgagagaagUCCaCCaCUsU | 251 |
| R-008380361-000Z | 1665 | 2 | GUGGUGGACUUCUCUCAAU | B GuGGuGGAcuucucucAAuUsU B | 252 |
| R-008380361-000Z | 1665 | 2 | GUGGUGGACUUCUCUCAAU | AuuGAGAGAAGuccAccAcUsU | 234 |
| R-008380362-000H | 1663 | 1 | UCGUGGUGGACUUCUCUCA | B UCGUGGUGGACUUCUCUCAUsU B | 241 |
| R-008380362-000H | 1663 | 1 | UCGUGGUGGACUUCUCUCA | UGAgagaagUCCaCCaCgaUsU | 238 |
| R-008380363-000S | 1663 | 1 | UCGUGGUGGACUUCUCUCA | B UCGUGGUGGACUUCUCUCAUsU B | 241 |
| R-008380363-000S | 1663 | 1 | UCGUGGUGGACUUCUCUCA | UGAGAGAAGUCCACCACGAUsU | 240 |
| R-008380365-000J | 1663 | 1 | UCGUGGUGGACUUCUCUCA | uGAGAGAAGuccAccAcGAUsU | 243 |
| R-008380365-000J | 1663 | 1 | UCGUGGUGGACUUCUCUCA | B ucGuGGuGGAcuucucucAUsU B | 253 |

TABLE 1c-continued

HBV siNA Strands Synthesized (Antisense sequences are readily identified as having complete or partial complementarity to the target sequence shown).

| siNA duplex ID | Target Site | SEQ ID NO: Target Sequence | Modified Sequence | SEQ ID NO: |
|---|---|---|---|---|
| R-008380367-000B | 2670 | 4 CCGAUCCAUACUGCGGAAC | B CCGAUCCAUACUGCGGAACUsU B | 222 |
| R-008380367-000B | 2670 | 4 CCGAUCCAUACUGCGGAAC | GUUCCGCAGUAUGGAUCGGUsU | 254 |
| R-008380369-000U | 2670 | 4 CCGAUCCAUACUGCGGAAC | B CCGAUCCAUACUGCGGAACUsU B | 222 |
| R-008380369-000U | 2670 | 4 CCGAUCCAUACUGCGGAAC | GUUCCgCagUaUggaUCggUsU | 255 |
| R-008380370-000H | 2669 | 3 GCCGAUCCAUACUGCGGAA | B GCCGAUCCAUACUGCGGAAUsU B | 226 |
| R-008380370-000H | 2669 | 3 GCCGAUCCAUACUGCGGAA | UUCCGCAGUAUGGAUCGGCUsU | 248 |
| R-008380372-000A | 1665 | 2 GUGGUGGACUUCUCUCAAU | B GuGGuGGAcuucucucAAuUsU B | 233 |
| R-008380372-000A | 1665 | 2 GUGGUGGACUUCUCUCAAU | AUUGAGAGAAGUCCACCACUsU | 256 |
| R-008380374-000T | 1665 | 2 GUGGUGGACUUCUCUCAAU | B GUGGUGGACUUCUCUCAAUUsU B | 257 |
| R-008380374-000T | 1665 | 2 GUGGUGGACUUCUCUCAAU | AUUgagagaagUCCaCCaCUsU | 251 |
| R-008380377-000U | 1665 | 2 GUGGUGGACUUCUCUCAAU | B GuGGuGGAcuucucucAAuUsU B | 258 |
| R-008380377-000U | 1665 | 2 GUGGUGGACUUCUCUCAAU | AUUGAGAGAAGuccAccAcUsU | 259 |
| R-008380378-000C | 1663 | 1 UCGUGGUGGACUUCUCUCA | B UCGUGGUGGACUUCUCUCAUsU B | 244 |
| R-008380378-000C | 1663 | 1 UCGUGGUGGACUUCUCUCA | UGAGAGAAGuccAccAcGAUsU | 239 |
| R-008380379-000L | 1663 | 1 UCGUGGUGGACUUCUCUCA | B UCGUGGUGGACUUCUCUCAUsU B | 241 |
| R-008380379-000L | 1663 | 1 UCGUGGUGGACUUCUCUCA | UGAGAGAAGuccAccAcGAUsU | 239 |
| R-008380381-000J | 1663 | 1 UCGUGGUGGACUUCUCUCA | B ucGuGGuGGAcuucucucAUsU B | 237 |
| R-008380381-000J | 1663 | 1 UCGUGGUGGACUUCUCUCA | UGAGAGAAGUCCACCACGAUsU | 260 |
| R-008380383-000B | 2670 | 4 CCGAUCCAUACUGCGGAAC | B CCGAUCCAUACUGCGGAACUsU B | 261 |
| R-008380383-000B | 2670 | 4 CCGAUCCAUACUGCGGAAC | GUUCCgCagUaUggaUCggUsU | 255 |
| R-008380384-000K | 2670 | 4 CCGAUCCAUACUGCGGAAC | B CCGAUCCAUACUGCGGAACUsU B | 261 |
| R-008380384-000K | 2670 | 4 CCGAUCCAUACUGCGGAAC | GuuccGcAGuAuGGAucGGUsU | 223 |
| R-008380386-000C | 2670 | 4 CCGAUCCAUACUGCGGAAC | B ccGAuccAuAcUgCgGAAcUsU B | 262 |
| R-008380386-000C | 2670 | 4 CCGAUCCAUACUGCGGAAC | GuuccGcAGuAuGGAucGGUsU | 223 |
| R-008380387-000L | 2669 | 3 GCCGAUCCAUACUGCGGAA | uuccGcAGuAuGGAucGGcUsU | 228 |
| R-008380387-000L | 2669 | 3 GCCGAUCCAUACUGCGGAA | B GCCGAUCCAUACUGCGGAAUsU B | 247 |
| R-008380389-000D | 1665 | 2 GUGGUGGACUUCUCUCAAU | B GUGGUGGACUUCUCUCAAUUsU B | 250 |
| R-008380389-000D | 1665 | 2 GUGGUGGACUUCUCUCAAU | AUUgagagaagUCCaCCaCUsU | 263 |
| R-008380390-000T | 1665 | 2 GUGGUGGACUUCUCUCAAU | B GuGGuGGAcuucucucAAuUsU B | 233 |
| R-008380390-000T | 1665 | 2 GUGGUGGACUUCUCUCAAU | AUUGAGAGAAGuccAccAcUsU | 259 |
| R-008380391-000B | 1665 | 2 GUGGUGGACUUCUCUCAAU | B GUGGUGGACUUCUCUCAAUUsU B | 250 |
| R-008380391-000B | 1665 | 2 GUGGUGGACUUCUCUCAAU | AuuGAGAGAAGuccAccAcUsU | 234 |
| R-008380394-000C | 1663 | 1 UCGUGGUGGACUUCUCUCA | B UCGUGGUGGACUUCUCUCAUsU B | 264 |
| R-008380394-000C | 1663 | 1 UCGUGGUGGACUUCUCUCA | UGAGAGAAGUCCACCACGAUsU | 265 |
| R-008380396-000V | 2670 | 4 CCGAUCCAUACUGCGGAAC | B CCGAUCCAUACUGCGGAACUsU B | 222 |
| R-008380396-000V | 2670 | 4 CCGAUCCAUACUGCGGAAC | GUUCCgCagUaUggaUCggUsU | 266 |

TABLE 1c-continued

HBV siNA Strands Synthesized (Antisense sequences are readily identified as having complete or partial complementarity to the target sequence shown).

| siNA duplex ID | Target Site | SEQ ID NO: Target Sequence | Modified Sequence | SEQ ID NO: |
|---|---|---|---|---|
| R-008380397-000D | 2670 | 4 CCGAUCCAUACUGCGGAAC | B ccGAuccAuAcuGcGGAAcUsU B | 220 |
| R-008380397-000D | 2670 | 4 CCGAUCCAUACUGCGGAAC | GUUccGcAGuAuGGAucGGUsU | 246 |
| R-008380398-000M | 2670 | 4 CCGAUCCAUACUGCGGAAC | B CCGAUCCAUACUGCGGAACUsU B | 261 |
| R-008380398-000M | 2670 | 4 CCGAUCCAUACUGCGGAAC | GUUccGcAGuAuGGAucGGUsU | 246 |
| R-008380399-000W | 2670 | 4 CCGAUCCAUACUGCGGAAC | B CCGAUCCAUACUGCGGAACUsU B | 222 |
| R-008380399-000W | 2670 | 4 CCGAUCCAUACUGCGGAAC | GUUCCGCAGUAUGGAUCGGUsU | 221 |
| R-008380401-000E | 2669 | 3 GCCGAUCCAUACUGCGGAA | B GccGAuccAuAcuGcGGAAUsU B | 224 |
| R-008380401-000E | 2669 | 3 GCCGAUCCAUACUGCGGAA | UUCCGCAGUAUGGAUCGGCUsU | 267 |
| R-008380402-000N | 1665 | 2 GUGGUGGACUUCUCUCAAU | B GUGGUGGACUUCUCUCAAUUsU B | 250 |
| R-008380402-000N | 1665 | 2 GUGGUGGACUUCUCUCAAU | AUUGAGAGAAGuccAccAcUsU | 259 |
| R-008380404-000F | 1665 | 2 GUGGUGGACUUCUCUCAAU | B GuGGuGGAcuucucucAAuUsU B | 233 |
| R-008380404-000F | 1665 | 2 GUGGUGGACUUCUCUCAAU | AUUGAGAGAAGUCCACCACUsU | 268 |
| R-008380405-000P | 1665 | 2 GUGGUGGACUUCUCUCAAU | B GUGGUGGACUUCUCUCAAUUsU B | 257 |
| R-008380405-000P | 1665 | 2 GUGGUGGACUUCUCUCAAU | AUUGAGAGAAGUCCACCACUsU | 268 |
| R-008380406-000Y | 1665 | 2 GUGGUGGACUUCUCUCAAU | B GUGGUGGACUUCUCUCAAUUsU B | 250 |
| R-008380406-000Y | 1665 | 2 GUGGUGGACUUCUCUCAAU | AUUGAGAGAAGUCCACCACUsU | 268 |
| R-008380407-000G | 1663 | 1 UCGUGGUGGACUUCUCUCA | B UCGUGGUGGACUUCUCUCAUsU B | 241 |
| R-008380407-000G | 1663 | 1 UCGUGGUGGACUUCUCUCA | UGAGAGAAGUCCACCACGAUsU | 260 |
| R-008380408-000R | 1663 | 1 UCGUGGUGGACUUCUCUCA | uGAGAGAAGuccAccAcGAUsU | 243 |
| R-008380408-000R | 1663 | 1 UCGUGGUGGACUUCUCUCA | B UCGUGGUGGACUUCUCUCAUsU B | 241 |
| R-008380409-000Z | 2670 | 4 CCGAUCCAUACUGCGGAAC | B ccGAuccAuAcuGcGGAAcUsU B | 220 |
| R-008380409-000Z | 2670 | 4 CCGAUCCAUACUGCGGAAC | GUUCCgCagUaUggaUCggUsU | 266 |
| R-008380410-000N | 2670 | 4 CCGAUCCAUACUGCGGAAC | B CCGAUCCAUACUGCGGAACUsU B | 222 |
| R-008380410-000N | 2670 | 4 CCGAUCCAUACUGCGGAAC | GUUccGcAGuAuGGAucGGUsU | 246 |
| R-008380411-000X | 2670 | 4 CCGAUCCAUACUGCGGAAC | B ccGAuccAuAcuGcGGAAcUsU B | 220 |
| R-008380411-000X | 2670 | 4 CCGAUCCAUACUGCGGAAC | GUUCCGCAGUAUGGAUCGGUsU | 254 |
| R-008380412-000F | 2670 | 4 CCGAUCCAUACUGCGGAAC | B ccGAuccAuAcuGcGGAAcUsU B | 220 |
| R-008380412-000F | 2670 | 4 CCGAUCCAUACUGCGGAAC | GUUCCgCagUaUggaUCggUsU | 255 |
| R-008380413-000P | 2669 | 3 GCCGAUCCAUACUGCGGAA | B GCCGAUCCAUACUGCGGAAUsU B | 247 |
| R-008380413-000P | 2669 | 3 GCCGAUCCAUACUGCGGAA | UUCcGcAGuAuGGAucGGcUsU | 230 |
| R-008380414-000Y | 2669 | 3 GCCGAUCCAUACUGCGGAA | B GCCGAUCCAUACUGCGGAAUsU B | 226 |
| R-008380414-000Y | 2669 | 3 GCCGAUCCAUACUGCGGAA | UUCCGCAGUAUGGAUCGGCUsU | 267 |
| R-008380415-000G | 1665 | 2 GUGGUGGACUUCUCUCAAU | B GuGGuGGAcuucucucAAuUsU B | 233 |
| R-008380415-000G | 1665 | 2 GUGGUGGACUUCUCUCAAU | AUUgagagaagUCCaCCaCUsU | 263 |
| R-008380416-000R | 1665 | 2 GUGGUGGACUUCUCUCAAU | B GUGGUGGACUUCUCUCAAUUsU B | 257 |
| R-008380416-000R | 1665 | 2 GUGGUGGACUUCUCUCAAU | AUUgagagaagUCCaCCaCUsU | 263 |

TABLE 1c-continued

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008380417-000Z | 1665 | 2 | GUGGUGGACUUCUCUCAAU | B GUGGUGGACUUCUCUCAAUUsU B | 250 |
| R-008380417-000Z | 1665 | 2 | GUGGUGGACUUCUCUCAAU | AUUGAGAGAAGUCCACCACUsU | 256 |
| R-008380418-000H | 1663 | 1 | UCGUGGUGGACUUCUCUCA | B UCGUGGUGGACUUCUCUCAUsU B | 244 |
| R-008380418-000H | 1663 | 1 | UCGUGGUGGACUUCUCUCA | UGAgagaagUCCaCCaCgaUsU | 242 |
| R-008380420-000F | 1663 | 1 | UCGUGGUGGACUUCUCUCA | B ucGuGGuGGAcuucucucAUsU B | 269 |
| R-008380420-000F | 1663 | 1 | UCGUGGUGGACUUCUCUCA | UGAGAGAAGuccAccAcGAUsU | 239 |
| R-008380421-000P | 2670 | 4 | CCGAUCCAUACUGCGGAAC | B CCGAUCCAUACUGCGGAACUsU B | 261 |
| R-008380421-000P | 2670 | 4 | CCGAUCCAUACUGCGGAAC | GUUCCgCagUaUggaUCggUsU | 266 |
| R-008380422-000Y | 2670 | 4 | CCGAUCCAUACUGCGGAAC | B CCGAUCCAUACUGCGGAACUsU B | 261 |
| R-008380422-000Y | 2670 | 4 | CCGAUCCAUACUGCGGAAC | GUUCCGCAGUAUGGAUCGGUsU | 254 |
| R-008380423-000G | 2670 | 4 | CCGAUCCAUACUGCGGAAC | B ccGAuccAuAcuGcGGAAcUsU B | 220 |
| R-008380423-000G | 2670 | 4 | CCGAUCCAUACUGCGGAAC | GuuccGcAGuAuGGAucGGUsU | 223 |
| R-008380426-000H | 2670 | 4 | CCGAUCCAUACUGCGGAAC | B CCGAUCCAUACUGCGGAACUsU B | 270 |
| R-008380426-000H | 2670 | 4 | CCGAUCCAUACUGCGGAAC | GUUCCGCAGUAUGGAUCGGUsU | 271 |
| R-008380427-0005 | 2669 | 3 | GCCGAUCCAUACUGCGGAA | B GCCGAUCCAUACUGCGGAAUsU B | 247 |
| R-008380427-0005 | 2669 | 3 | GCCGAUCCAUACUGCGGAA | UUCCGCAGUAUGGAUCGGCUsU | 267 |
| R-008380428-000A | 1665 | 2 | GUGGUGGACUUCUCUCAAU | B GUGGUGGACUUCUCUCAAUUsU B | 257 |
| R-008380428-000A | 1665 | 2 | GUGGUGGACUUCUCUCAAU | AUUGAGAGAAGuccAccAcUsU | 259 |
| R-008380429-000J | 1665 | 2 | GUGGUGGACUUCUCUCAAU | B GUGGUGGACUUCUCUCAAUUsU B | 257 |
| R-008380429-000J | 1665 | 2 | GUGGUGGACUUCUCUCAAU | AUUGAGAGAAGUCCACCACUsU | 256 |
| R-008380430-000Y | 1665 | 2 | GUGGUGGACUUCUCUCAAU | B GuGGuGGAcuucucucAAuUsU B | 233 |
| R-008380430-000Y | 1665 | 2 | GUGGUGGACUUCUCUCAAU | AUUgagagaagUCCaCCaCUsU | 251 |
| R-008380431-000G | 1665 | 2 | GUGGUGGACUUCUCUCAAU | B GUGGUGGACUUCUCUCAAUUsU B | 257 |
| R-008380431-000G | 1665 | 2 | GUGGUGGACUUCUCUCAAU | AuuGAGAGAAGuccAccAcUsU | 234 |
| R-008380432-000R | 1663 | 1 | UCGUGGUGGACUUCUCUCA | B UCGUGGUGGACUUCUCUCAUsU B | 244 |
| R-008380432-000R | 1663 | 1 | UCGUGGUGGACUUCUCUCA | UGAGAGAAGUCCACCACGAUsU | 240 |
| R-008380433-000Z | 1663 | 1 | UCGUGGUGGACUUCUCUCA | B ucGuGGuGGAcuucucucAUsU B | 237 |
| R-008380433-000Z | 1663 | 1 | UCGUGGUGGACUUCUCUCA | UGAgagaagUCCaCCaCgaUsU | 242 |
| R-008380434-000H | 2670 | 4 | CCGAUCCAUACUGCGGAAC | B CCGAUCCAUACUGCGGAACUsU B | 261 |
| R-008380434-000H | 2670 | 4 | CCGAUCCAUACUGCGGAAC | GUUCCGCAGUAUGGAUCGGUsU | 221 |
| R-008380435-000S | 2669 | 3 | GCCGAUCCAUACUGCGGAA | B GCCGAUCCAUACUGCGGAAUsU B | 226 |
| R-008380435-000S | 2669 | 3 | GCCGAUCCAUACUGCGGAA | UUCcGcAGuAuGGAucGGcUsU | 230 |
| R-008380436-000A | 1663 | 1 | UCGUGGUGGACUUCUCUCA | B UCGUGGUGGACUUCUCUCAUsU B | 244 |
| R-008380436-000A | 1663 | 1 | UCGUGGUGGACUUCUCUCA | UGAgagaagUCCaCCaCgaUsU | 238 |
| R-008380437-000J | 1663 | 1 | UCGUGGUGGACUUCUCUCA | B UCGUGGUGGACUUCUCUCAUsU B | 244 |
| R-008380437-000J | 1663 | 1 | UCGUGGUGGACUUCUCUCA | UGAGAGAAGUCCACCACGAUsU | 260 |

TABLE 1c-continued

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008380438-000T | 1663 | 1 | UCGUGGUGGACUUCUCUCA | uGAGAGAAGuccAccAcGAUsU | 243 |
| R-008380438-000T | 1663 | 1 | UCGUGGUGGACUUCUCUCA B | ucGuGGuGGAcuucucucAUsU B | 237 |
| R-008380441-000Z | 2670 | 4 | CCGAUCCAUACUGCGGAAC B | CCGAUCCAUaCUgCggAACUsU B | 272 |
| R-008380441-000Z | 2670 | 4 | CCGAUCCAUACUGCGGAAC | GUUcCgcaGuAUggAuCgGUsU | 273 |
| R-008380444-000A | 2670 | 4 | CCGAUCCAUACUGCGGAAC B | CCgAUCCaUaCUgcGgaACUsU B | 274 |
| R-008380444-000A | 2670 | 4 | CCGAUCCAUACUGCGGAAC | GuucCgCAgUAUGgAUCgGUsU | 275 |
| R-008380447-000B | 2670 | 4 | CCGAUCCAUACUGCGGAAC | gUuCcgCaGuauGgaUcGGUsU | 276 |
| R-008380447-000B | 2670 | 4 | CCGAUCCAUACUGCGGAAC B | cCGAUCCauACUGCgGAACUsU B | 277 |
| R-008380450-000H | 2669 | 3 | GCCGAUCCAUACUGCGGAA | uUccGCAGuaUgGaUCgGCUsU | 278 |
| R-008380450-000H | 2669 | 3 | GCCGAUCCAUACUGCGGAA B | GCCgaUCCaUACUGCgGaAUsU B | 279 |
| R-008380453-000J | 1665 | 2 | GUGGUGGACUUCUCUCAAU B | GUGGUGgACUUcUCUCAAUUsU B | 280 |
| R-008380453-000J | 1665 | 2 | GUGGUGGACUUCUCUCAAU | AuugAgAgAAgUCcACCACUsU | 281 |
| R-008380456-000K | 1665 | 2 | GUGGUGGACUUCUCUCAAU | aUUgAGAgAAgUCcACcaCUsU | 282 |
| R-008380456-000K | 1665 | 2 | GUGGUGGACUUCUCUCAAU B | GUGgUgGaCUUCUCUCAAUUsU B | 283 |
| R-008380459-000L | 1665 | 2 | GUGGUGGACUUCUCUCAAU B | GUGgUggaCUUCUCUCaaUUsU B | 284 |
| R-008380459-000L | 1665 | 2 | GUGGUGGACUUCUCUCAAU | AUugaGaGaAGuCcACCACUsU | 285 |
| R-008380462-000T | 1663 | 1 | UCGUGGUGGACUUCUCUCA B | UCGUGGUggaCuUCUCUCaUsU B | 286 |
| R-008380462-000T | 1663 | 1 | UCGUGGUGGACUUCUCUCA | UGaGAGAaGUcCacCacCgAUsU | 287 |
| R-008380465-000U | 2670 | 4 | CCGAUCCAUACUGCGGAAC | gUuccGCAgUaUgGAuCggUsU | 288 |
| R-008380465-000U | 2670 | 4 | CCGAUCCAUACUGCGGAAC B | CCGaUCCAUaCuGCGgAAcUsU B | 289 |
| R-008380468-000V | 2669 | 3 | GCCGAUCCAUACUGCGGAA | uUCcGcAgUAUGgAUcggCUsU | 290 |
| R-008380468-000V | 2669 | 3 | GCCGAUCCAUACUGCGGAA B | GCCGAuCCAUaCuGCggaaUsU B | 291 |
| R-008380471-000B | 2669 | 3 | GCCGAUCCAUACUGCGGAA | uUCcgCaGuAUggAUcGGCUsU | 292 |
| R-008380471-000B | 2669 | 3 | GCCGAUCCAUACUGCGGAA B | gcCGAUCCAUACUGCGGAaUsU B | 293 |
| R-008380474-000C | 2669 | 3 | GCCGAUCCAUACUGCGGAA B | GcCGAUCCAUACUGCGGaAUsU B | 294 |
| R-008380474-000C | 2669 | 3 | GCCGAUCCAUACUGCGGAA | UUCcGCagUaUgGAuCGGcUsU | 295 |
| R-008380477-000D | 1665 | 2 | GUGGUGGACUUCUCUCAAU B | GUgGUGGaCUUCUCUcaaUUsU B | 296 |
| R-008380477-000D | 1665 | 2 | GUGGUGGACUUCUCUCAAU | AuUGaGaGaAgUcCACcacUsU | 297 |
| R-008380480-000K | 1665 | 2 | GUGGUGGACUUCUCUCAAU | aUuGAGAgaAgUccACCACUsU | 298 |
| R-008380480-000K | 1665 | 2 | GUGGUGGACUUCUCUCAAU B | GUGGUggACUuCUCUCAAUUsU B | 299 |
| R-008380483-000L | 1665 | 2 | GUGGUGGACUUCUCUCAAU B | gUGGUGGACUUCUcUCaAUUsU B | 300 |
| R-008380483-000L | 1665 | 2 | GUGGUGGACUUCUCUCAAU | AUuGAGAGAAgUCCAcCaCUsU | 301 |
| R-008380486-000M | 1663 | 1 | UCGUGGUGGACUUCUCUCA B | UCgUGGUGGaCUUcUCUCAUsU B | 302 |
| R-008380486-000M | 1663 | 1 | UCGUGGUGGACUUCUCUCA | UGaGagAAguccAcCACgaUsU | 303 |
| R-008380489-000N | 1663 | 1 | UCGUGGUGGACUUCUCUCA | uGaGAGaAguCcacCACgAUsU | 304 |
| R-008380489-000N | 1663 | 1 | UCGUGGUGGACUUCUCUCA B | uCGUggugGACUUCUCuCAUsU B | 305 |

TABLE 1c-continued

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008380492-000V | 1663 | 1 | UCGUGGUGGACUUCUCUCA | ug<u>AG</u>a<u>G</u>A<u>a</u>G<u>UC</u>caCca<u>CGAU</u>s<u>U</u> | 306 |
| R-008380492-000V | 1663 | 1 | UCGUGGUGGACUUCUCUCA | B <u>UCG</u>ugg<u>UGG</u>a<u>CUU</u>Cuc<u>UC</u>A<u>U</u>s<u>U</u> B | 307 |
| R-008380495-000W | 2670 | 4 | CCGAUCCAUACUGCGGAAC | B <u>Cc</u>G<u>AUCC</u>A<u>U</u>AC<u>U</u>gc<u>G</u>ga<u>AC</u>U<u>s</u>U B | 308 |
| R-008380495-000W | 2670 | 4 | CCGAUCCAUACUGCGGAAC | <u>G</u>uu<u>CC</u>G<u>C</u>a<u>G</u>U<u>A</u>U<u>G</u>gau<u>CGG</u>U<u>s</u>U | 309 |
| R-008380498-000X | 2670 | 4 | CCGAUCCAUACUGCGGAAC | B <u>CC</u>GAU<u>CC</u>A<u>U</u>aCu<u>GCGG</u>Aa<u>C</u>U<u>s</u>U B | 310 |
| R-008380498-000X | 2670 | 4 | CCGAUCCAUACUGCGGAAC | <u>GUUCCGCAGUAU</u>G<u>GAU</u>c<u>G</u>U<u>s</u>U | 311 |
| R-008380501-000P | 2670 | 4 | CCGAUCCAUACUGCGGAAC | B C<u>CG</u>AU<u>CC</u>A<u>U</u>A<u>CUGCGG</u>Aa<u>C</u>U<u>s</u>U B | 312 |
| R-008380501-000P | 2670 | 4 | CCGAUCCAUACUGCGGAAC | <u>GUU</u>c<u>CG</u>Cag<u>U</u>aug<u>G</u>AU<u>c</u>G<u>g</u>U<u>s</u>U | 313 |
| R-008380504-000R | 2670 | 4 | CCGAUCCAUACUGCGGAAC | g<u>UUC</u>cg<u>C</u>A<u>GU</u>a<u>UGG</u>a<u>U</u>C<u>GG</u>U<u>s</u>U | 314 |
| R-008380504-000R | 2670 | 4 | CCGAUCCAUACUGCGGAAC | B <u>CC</u>Ga<u>UCC</u>A<u>U</u>A<u>CUG</u>Cgga<u>AC</u>U<u>s</u>U B | 315 |
| R-008380507-000S | 2669 | 3 | GCCGAUCCAUACUGCGGAA | B <u>GCC</u>ga<u>UCC</u>A<u>U</u>A<u>CU</u>g<u>C</u>GG<u>aaU</u>s<u>U</u> B | 316 |
| R-008380507-000S | 2669 | 3 | GCCGAUCCAUACUGCGGAA | <u>UUCC</u>gc<u>AG</u>Ua<u>U</u>ggau<u>CGG</u>c<u>U</u>s<u>U</u> | 317 |
| R-008380510-000Y | 1665 | 2 | GUGGUGGACUUCUCUCAAU | au<u>U</u>g<u>AGAGA</u>a<u>GU</u>ccacCa<u>CU</u>s<u>U</u> | 318 |
| R-008380510-000Y | 1665 | 2 | GUGGUGGACUUCUCUCAAU | B <u>GU</u>gg<u>U</u>gga<u>ACUU</u>Cu<u>C</u>u<u>C</u>aa<u>UU</u>s<u>U</u> B | 319 |
| R-008380513-000Z | 1665 | 2 | GUGGUGGACUUCUCUCAAU | B g<u>U</u>gg<u>U</u>gga<u>CUUCUCUC</u>aa<u>UU</u>s<u>U</u> B | 320 |
| R-008380513-000Z | 1665 | 2 | GUGGUGGACUUCUCUCAAU | <u>A</u>UU<u>GA</u>g<u>A</u>gaa<u>GU</u>ccac<u>CACU</u>s<u>U</u> | 321 |
| R-008380516-000A | 1665 | 2 | GUGGUGGACUUCUCUCAAU | B g<u>UGGUGG</u>a<u>C</u>UU<u>CUCUC</u>Aa<u>UU</u>s<u>U</u> B | 322 |
| R-008380516-000A | 1665 | 2 | GUGGUGGACUUCUCUCAAU | <u>A</u>uu<u>GA</u>g<u>A</u>G<u>A</u>a<u>GUCC</u>a<u>CC</u>a<u>CU</u>s<u>U</u> | 323 |
| R-008380519-000B | 2670 | 4 | CCGAUCCAUACUGCGGAAC | B <u>CC</u>ga<u>UCC</u>Auac<u>U</u>gc<u>gg</u>a<u>AC</u>U<u>s</u>U B | 324 |
| R-008380519-000B | 2670 | 4 | CCGAUCCAUACUGCGGAAC | <u>G</u>Uu<u>CC</u>G<u>c</u>A<u>GU</u>A<u>U</u>G<u>g</u>au<u>C</u>gg<u>U</u>s<u>U</u> | 325 |
| R-008380522-000H | 2669 | 3 | GCCGAUCCAUACUGCGGAA | B g<u>CC</u>ga<u>UCC</u>a<u>U</u>a<u>CU</u>g<u>C</u>ggaa<u>U</u>s<u>U</u> B | 326 |
| R-008380522-000H | 2669 | 3 | GCCGAUCCAUACUGCGGAA | <u>UU</u>c<u>C</u>G<u>C</u>ag<u>U</u>A<u>U</u>G<u>G</u>aU<u>c</u>G<u>g</u>C<u>U</u>s<u>U</u> | 327 |
| R-008380525-000J | 2669 | 3 | GCCGAUCCAUACUGCGGAA | u<u>U</u>c<u>C</u>g<u>CAGU</u>A<u>U</u>G<u>G</u>a<u>U</u>C<u>GG</u>C<u>U</u>s<u>U</u> | 328 |
| R-008380525-000J | 2669 | 3 | GCCGAUCCAUACUGCGGAA | B <u>G</u>ccga<u>UCC</u>a<u>U</u>A<u>CU</u>G<u>C</u>g<u>G</u>A<u>AU</u>s<u>U</u> B | 329 |
| R-008380528-000K | 2669 | 3 | GCCGAUCCAUACUGCGGAA | uu<u>C</u>C<u>g</u>C<u>AG</u>u<u>AUg</u>G<u>a</u>U<u>CGGCU</u>s<u>U</u> | 330 |
| R-008380528-000K | 2669 | 3 | GCCGAUCCAUACUGCGGAA | B <u>GCC</u>A<u>u</u>C<u>C</u>a<u>U</u>A<u>C</u>U<u>g</u>C<u>GG</u>A<u>AU</u>s<u>U</u> B | 331 |
| R-008380531-000S | 1665 | 2 | GUGGUGGACUUCUCUCAAU | a<u>UU</u>gag<u>AG</u>A<u>A</u>guCc<u>A</u>CC<u>A</u>c<u>U</u>s<u>U</u> | 332 |
| R-008380531-000S | 1665 | 2 | GUGGUGGACUUCUCUCAAU | B g<u>U</u>gg<u>U</u>gg<u>A</u>cuU<u>CUC</u>U<u>C</u>Aa<u>UU</u>s<u>U</u> B | 333 |
| R-008380534-000T | 1663 | 1 | UCGUGGUGGACUUCUCUCA | u<u>GAG</u>A<u>GAA</u>g<u>UCC</u>ac<u>C</u>AC<u>GAU</u>s<u>U</u> | 334 |
| R-008380534-000T | 1663 | 1 | UCGUGGUGGACUUCUCUCA | B <u>UCGUGG</u>U<u>gg</u>A<u>C</u>uu<u>CUCUC</u>A<u>U</u>s<u>U</u> B | 335 |
| R-008380537-000U | 1663 | 1 | UCGUGGUGGACUUCUCUCA | B <u>UC</u>g<u>U</u>g<u>GUg</u>G<u>ACUUCUCUC</u>A<u>U</u>s<u>U</u> B | 336 |
| R-008380537-000U | 1663 | 1 | UCGUGGUGGACUUCUCUCA | <u>UG</u>ag<u>A</u>g<u>A</u>a<u>G</u>u<u>CC</u>acc<u>A</u>C<u>G</u>a<u>U</u>s<u>U</u> | 337 |
| R-008380540-000A | 1663 | 1 | UCGUGGUGGACUUCUCUCA | B <u>UC</u>gug<u>GUGG</u>A<u>CUUCUCUC</u>c<u>A</u>U<u>s</u>U B | 338 |
| R-008380540-000A | 1663 | 1 | UCGUGGUGGACUUCUCUCA | <u>U</u>g<u>AGA</u>g<u>A</u>ag<u>UCC</u>A<u>c</u>C<u>AC</u>G<u>AU</u>s<u>U</u> | 339 |
| R-008380543-000B | 1663 | 1 | UCGUGGUGGACUUCUCUCA | B <u>UCGUGGUGG</u>A<u>C</u>U<u>U</u>C<u>U</u>C<u>U</u>ca<u>U</u>s<u>U</u> B | 340 |
| R-008380543-000B | 1663 | 1 | UCGUGGUGGACUUCUCUCA | <u>U</u>gagag<u>AA</u>G<u>u</u>c<u>C</u><u>A</u>C<u>C</u>A<u>c</u>g<u>A</u>U<u>s</u>U | 341 |

TABLE 1c-continued

HBV siNA Strands Synthesized (Antisense sequences are readily identified as having complete or partial complementarity to the target sequence shown).

| siNA duplex ID | Target Site | SEQ ID NO:Target Sequence | Modified Sequence | SEQ ID NO: |
|---|---|---|---|---|
| R-008380546-000C | 2670 | 4 CCGAUCCAUACUGCGGAAC | gUuCcGCAgUAUggAUcgGUsU | 342 |
| R-008380546-000C | 2670 | 4 CCGAUCCAUACUGCGGAAC | B CCGaUCCAUACUGCGgaACUsU B | 343 |
| R-008380549-000D | 2670 | 4 CCGAUCCAUACUGCGGAAC | guUCCGcAGuAUggaUCGgUsU | 344 |
| R-008380549-000D | 2670 | 4 CCGAUCCAUACUGCGGAAC | B CCgAUCcaUaCugCGGAACUsU B | 345 |
| R-008380552-000K | 2669 | 3 GCCGAUCCAUACUGCGGAA | B GcCgAUCCAUaCUgcGgaAUsU B | 346 |
| R-008380552-000K | 2669 | 3 GCCGAUCCAUACUGCGGAA | UuCCgCAGUAugGaUcGGCUsU | 347 |
| R-008380555-000L | 2669 | 3 GCCGAUCCAUACUGCGGAA | B GCCGaUCCAUACUGcGGAaUsU B | 348 |
| R-008380555-000L | 2669 | 3 GCCGAUCCAUACUGCGGAA | UucCgCAGUAuGgaUCgGcUsU | 349 |
| R-008380558-000M | 1665 | 2 GUGGUGGACUUCUCUCAAU | auuGaGaGAAagUCCAcCACUsU | 350 |
| R-008380558-000M | 1665 | 2 GUGGUGGACUUCUCUCAAU | B GUgGUGGAcUUCUCuCAaUUsU B | 351 |
| R-008380561-000U | 1665 | 2 GUGGUGGACUUCUCUCAAU | B gUGgUGGACUUCUCUCAAUUsU B | 352 |
| R-008380561-000U | 1665 | 2 GUGGUGGACUUCUCUCAAU | AUuGaGAGAaGUCcacCACUsU | 353 |
| R-008380564-000V | 1663 | 1 UCGUGGUGGACUUCUCUCA | ugagaGAAGUCcACcACgaUsU | 354 |
| R-008380564-000V | 1663 | 1 UCGUGGUGGACUUCUCUCA | B UCGUGGUGgaCUUCUCUCAUsU B | 355 |
| R-008380567-000W | 2669 | 3 GCCGAUCCAUACUGCGGAA | B GCcgaUCCAUaCUgCGGaAUsU B | 356 |
| R-008380567-000W | 2669 | 3 GCCGAUCCAUACUGCGGAA | UucCGCaGUaUGGauCGGCUsU | 357 |
| R-008380570-000C | 1665 | 2 GUGGUGGACUUCUCUCAAU | B GuGgUgGACUUcUCUCaAUUsU B | 358 |
| R-008380570-000C | 1665 | 2 GUGGUGGACUUCUCUCAAU | AUUgagAgAAGUcCAcCAcUsU | 359 |
| R-008380573-000D | 1665 | 2 GUGGUGGACUUCUCUCAAU | aUUGAgAgaaGuCCAcCacUsU | 360 |
| R-008380573-000D | 1665 | 2 GUGGUGGACUUCUCUCAAU | gUGguGgaCUuCUCUCAauUsU B | 361 |
| R-008380576-000E | 1665 | 2 GUGGUGGACUUCUCUCAAU | auUGagaGAAGUCcaCcAcUsU | 362 |
| R-008380576-000E | 1665 | 2 GUGGUGGACUUCUCUCAAU | gUgGuggACUUCUCUCaAUUsU B | 363 |
| R-008380579-000F | 1663 | 1 UCGUGGUGGACUUCUCUCA | B UCGUGgUggACUUCUCUCAUsU B | 364 |
| R-008380579-000F | 1663 | 1 UCGUGGUGGACUUCUCUCA | UGAgAGaAguCCAcCACGaUsU | 365 |
| R-008380582-000M | 1663 | 1 UCGUGGUGGACUUCUCUCA | B UCgUggUGgACUUCUCUcaUsU B | 366 |
| R-008380582-000M | 1663 | 1 UCGUGGUGGACUUCUCUCA | UGAgagaAGUcCAcCAcGAUsU | 367 |
| R-008380585-000N | 2670 | 4 CCGAUCCAUACUGCGGAAC | B CCGAUCCaUaCUgCgGAaCUsU B | 368 |
| R-008380585-000N | 2670 | 4 CCGAUCCAUACUGCGGAAC | GuuCCgCAGUAuggAUCGgUsU | 369 |
| R-008380588-000P | 2670 | 4 CCGAUCCAUACUGCGGAAC | guUcCGCAguAuGgaUCGGUsU | 370 |
| R-008380588-000P | 2670 | 4 CCGAUCCAUACUGCGGAAC | B CCgAUcCAuACUGCGGaACUsU B | 371 |
| R-008380591-000W | 2670 | 4 CCGAUCCAUACUGCGGAAC | gUUCcgCAGUAuggaUCGgUsU | 372 |
| R-008380591-000W | 2670 | 4 CCGAUCCAUACUGCGGAAC | B CcGaUCCAUaCUGCGGAacUsU B | 373 |
| R-008380594-000X | 2669 | 3 GCCGAUCCAUACUGCGGAA | B gCCgAUCCAUaCUgCGgAAUsU B | 374 |
| R-008380594-000X | 2669 | 3 GCCGAUCCAUACUGCGGAA | UuCCGCAgUAUGGaUCGGcUsU | 375 |
| R-008380597-000Y | 2669 | 3 GCCGAUCCAUACUGCGGAA | uuCCgcagUauGGaUCGGCUsU | 376 |
| R-008380597-000Y | 2669 | 3 GCCGAUCCAUACUGCGGAA | B GCCGAUCCAUACUgCGgaaUsU B | 377 |

TABLE 1c-continued

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008380600-000R | 2669 | 3 | GCCGAUCCAUACUGCGGAA | B GCCGAUCcauACUgCGgaAUsU B | 378 |
| R-008380600-000R | 2669 | 3 | GCCGAUCCAUACUGCGGAA | UUCCGcAGUaUGgaucGgCUsU | 379 |
| R-008380603-000S | 1663 | 1 | UCGUGGUGGACUUCUCUCA | B UCgUggUggaCUUCUCUCaUsU B | 380 |
| R-008380603-000S | 1663 | 1 | UCGUGGUGGACUUCUCUCA | UgaGAGAagUCcacCACgAUsU | 381 |
| R-008380606-000T | 1663 | 1 | UCGUGGUGGACUUCUCUCA | uGAgAgAAguCCACCacGAUsU | 382 |
| R-008380606-000T | 1663 | 1 | UCGUGGUGGACUUCUCUCA | B ucgUgGUgGaCUuCUCUCaUsU B | 383 |
| R-008380609-000U | 2670 | 4 | CCGAUCCAUACUGCGGAAC | guUccGCaGUAUggAUCGgUsU | 384 |
| R-008380609-000U | 2670 | 4 | CCGAUCCAUACUGCGGAAC | B CCgAUcCaUACUgCGgAACUsU B | 385 |
| R-008380612-000A | 2670 | 4 | CCGAUCCAUACUGCGGAAC | gUUCCGCagUAuGgaucGGUsU | 386 |
| R-008380612-000A | 2670 | 4 | CCGAUCCAUACUGCGGAAC | B CCgAUCCAUACUGCGgaaCUsU B | 387 |
| R-008380615-000B | 2670 | 4 | CCGAUCCAUACUGCGGAAC | gUUccGCAGUaUGgAUCGgUsU | 388 |
| R-008380615-000B | 2670 | 4 | CCGAUCCAUACUGCGGAAC | B CCgaUCCaUaCUgCggaaCUsU B | 389 |
| R-008380618-000C | 2670 | 4 | CCGAUCCAUACUGCGGAAC | B cCGaUCCaUACUGCggAACUsU B | 390 |
| R-008380618-000C | 2670 | 4 | CCGAUCCAUACUGCGGAAC | GuUCcgCAGuaugGaUCgUsU | 391 |
| R-008380621-000J | 2669 | 3 | GCCGAUCCAUACUGCGGAA | B gCCGaUCCaUACUGCggAaUsU B | 392 |
| R-008380621-000J | 2669 | 3 | GCCGAUCCAUACUGCGGAA | UUcCgCAGUauGGAUcggCUsU | 393 |
| R-008380624-000K | 2669 | 3 | GCCGAUCCAUACUGCGGAA | B gCCGaUCCaUaCUgCGgAAUsU B | 394 |
| R-008380624-000K | 2669 | 3 | GCCGAUCCAUACUGCGGAA | UUCCGCaGuAUGgaucgGCUsU | 395 |
| R-008380627-000L | 2669 | 3 | GCCGAUCCAUACUGCGGAA | uUCCGCAGUAUGGAUcggcUsU | 396 |
| R-008380627-000L | 2669 | 3 | GCCGAUCCAUACUGCGGAA | B GCCGAUCCAUACUGCggAAUsU B | 397 |
| R-008380630-000T | 2669 | 3 | GCCGAUCCAUACUGCGGAA | B GCCgAUCCAUACUGCGGAAUsU B | 398 |
| R-008380630-000T | 2669 | 3 | GCCGAUCCAUACUGCGGAA | UUcCgCAGuAuggauCGGCUsU | 399 |
| R-008380633-000U | 1665 | 2 | GUGGUGGACUUCUCUCAAU | B GugGUGgaCUUCUCUcAAUUsU B | 400 |
| R-008380633-000U | 1665 | 2 | GUGGUGGACUUCUCUCAAU | AuUGAGaGaaGUCCAccaCUsU | 401 |
| R-008380636-000V | 1665 | 2 | GUGGUGGACUUCUCUCAAU | B GUGGUGGACUUcUcUCaaUUsU B | 402 |
| R-008380636-000V | 1665 | 2 | GUGGUGGACUUCUCUCAAU | AuUGAgAGAAgucCaCCACUsU | 403 |
| R-008380639-000W | 1665 | 2 | GUGGUGGACUUCUCUCAAU | aUUGAGAgaAguccACCaCUsU | 404 |
| R-008380639-000W | 1665 | 2 | GUGGUGGACUUCUCUCAAU | B GUGgUgGaCUUCUCUCAAUUsU B | 405 |
| R-008380642-000C | 1663 | 1 | UCGUGGUGGACUUCUCUCA | B UCgUGgUgGACUUcUcUCaUsU B | 406 |
| R-008380642-000C | 1663 | 1 | UCGUGGUGGACUUCUCUCA | UgAGAgAAGuCCAcCacGaUsU | 407 |
| R-008380645-000D | 1663 | 1 | UCGUGGUGGACUUCUCUCA | B UCgUggUgGAcUUCUCUCAUsU B | 408 |
| R-008380645-000D | 1663 | 1 | UCGUGGUGGACUUCUCUCA | UgaGAGaAGUCCAcCacGaUsU | 409 |
| R-008380648-000E | 1663 | 1 | UCGUGGUGGACUUCUCUCA | ugAgaGaaGuCCAcCaCGAUsU | 410 |
| R-008380648-000E | 1663 | 1 | UCGUGGUGGACUUCUCUCA | B UCGUgguGGaCUUcUCUCaUsU B | 411 |
| R-008380651-000L | 1663 | 1 | UCGUGGUGGACUUCUCUCA | B uCGuGGUgGaCUUCUCUCAUsU B | 412 |
| R-008380651-000L | 1663 | 1 | UCGUGGUGGACUUCUCUCA | UgaGagaAGUcCcacCAcGaUsU | 413 |

TABLE 1c-continued

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008380654-000M | 1663 | 1 | UCGUGGUGGACUUCUCUCA | uGagAGAAgucCACCACGaUsU | 414 |
| R-008380654-000M | 1663 | 1 | UCGUGGUGGACUUCUCUCA | B UCGUGgUGgACUuCuCUCAUsU B | 415 |
| R-008380655-000W | 1665 | 2 | GUGGUGGACUUCUCUCAAU | B GUGGUGGACUUCUCUCAAUUsU B | 250 |
| R-008380655-000W | 1665 | 2 | GUGGUGGACUUCUCUCAAU | AUuGAGAGAAgUCCAcCaCUsU | 301 |
| R-008380656-000E | 1663 | 1 | UCGUGGUGGACUUCUCUCA | B UCGUGGUGGACUUCUCUCAUsU B | 244 |
| R-008380656-000E | 1663 | 1 | UCGUGGUGGACUUCUCUCA | UgAGAgAagUCCAcCACGAUsU | 339 |
| R-008380657-000N | 2670 | 4 | CCGAUCCAUACUGCGGAAC | B CCGAUCCAUACUGCGGAACUsU B | 222 |
| R-008380657-000N | 2670 | 4 | CCGAUCCAUACUGCGGAAC | GUUcCgcaGuAUggAuCgGUsU | 273 |
| R-008380658-000X | 2670 | 4 | CCGAUCCAUACUGCGGAAC | gUuccGCAgUaUgGAuCggUsU | 288 |
| R-008380658-000X | 2670 | 4 | CCGAUCCAUACUGCGGAAC | B CCGAUCCAUACUGCGGAACUsU B | 261 |
| R-008380659-000F | 2670 | 4 | CCGAUCCAUACUGCGGAAC | B CCGAUCCAUACUGCGGAACUsU B | 261 |
| R-008380659-000F | 2670 | 4 | CCGAUCCAUACUGCGGAAC | GUuCCgcAGUaUGgauCggUsU | 325 |
| R-008380660-000V | 2669 | 3 | GCCGAUCCAUACUGCGGAA | uUccGCAGuaUgGaUCgGCUsU | 278 |
| R-008380660-000V | 2669 | 3 | GCCGAUCCAUACUGCGGAA | B GCCGAUCCAUACUGCGGAAUsU B | 226 |
| R-008380661-000D | 1665 | 2 | GUGGUGGACUUCUCUCAAU | B GuGGuGGAcuucucucAAuUsU B | 233 |
| R-008380661-000D | 1665 | 2 | GUGGUGGACUUCUCUCAAU | AuUGaGaGaAgUcCACcacUsU | 297 |
| R-008380662-000M | 1663 | 1 | UCGUGGUGGACUUCUCUCA | B ucGuGGuGGAcuucucucAUsU B | 237 |
| R-008380662-000M | 1663 | 1 | UCGUGGUGGACUUCUCUCA | UgaGAGAagUCcacCACgAUsU | 381 |
| R-008380663-000W | 1663 | 1 | UCGUGGUGGACUUCUCUCA | B ucGuGGuGGAcuucucucAUsU B | 237 |
| R-008380663-000W | 1663 | 1 | UCGUGGUGGACUUCUCUCA | UGAgAGaAguCCAcCACGaUsU | 365 |
| R-008380664-000E | 1663 | 1 | UCGUGGUGGACUUCUCUCA | B UCGUGGUGGACUUCUCUCAUsU B | 244 |
| R-008380664-000E | 1663 | 1 | UCGUGGUGGACUUCUCUCA | UGaGagAAguccAcCACgaUsU | 303 |
| R-008380665-000N | 1663 | 1 | UCGUGGUGGACUUCUCUCA | ugAGaGaaGuCCAcCaCGAUsU | 410 |
| R-008380665-000N | 1663 | 1 | UCGUGGUGGACUUCUCUCA | B UCGUGGUGGACUUCUCUCAUsU B | 241 |
| R-008380666-000X | 1663 | 1 | UCGUGGUGGACUUCUCUCA | uGaGAGaAguCcacCACgAUsU | 304 |
| R-008380666-000X | 1663 | 1 | UCGUGGUGGACUUCUCUCA | B ucGuGGuGGAcuucucucAUsU B | 237 |
| R-008380667-000F | 1663 | 1 | UCGUGGUGGACUUCUCUCA | uGagAGAAgucCACCACGaUsU | 414 |
| R-008380667-000F | 1663 | 1 | UCGUGGUGGACUUCUCUCA | B UCGUGGUGGACUUCUCUCAUsU B | 241 |
| R-008380668-000P | 2669 | 3 | GCCGAUCCAUACUGCGGAA | B GccGAuccAuAcUgCGGAAUsU B | 224 |
| R-008380668-000P | 2669 | 3 | GCCGAUCCAUACUGCGGAA | UUCCGCaGuAUGgaucgCUsU | 395 |
| R-008380669-000Y | 2669 | 3 | GCCGAUCCAUACUGCGGAA | B GCCGAUCCAUACUGCGGAAUsU B | 226 |
| R-008380669-000Y | 2669 | 3 | GCCGAUCCAUACUGCGGAA | UUCCgcAGUaUggauCGGcUsU | 317 |
| R-008380670-000M | 1665 | 2 | GUGGUGGACUUCUCUCAAU | aUUGAGAgaAguccACCaCUsU | 404 |
| R-008380670-000M | 1665 | 2 | GUGGUGGACUUCUCUCAAU | B GUGGUGGACUUCUCUCAAUUsU B | 257 |
| R-008380671-000W | 1663 | 1 | UCGUGGUGGACUUCUCUCA | B UCGUGGUGGACUUCUCUCAUsU B | 241 |
| R-008380671-000W | 1663 | 1 | UCGUGGUGGACUUCUCUCA | UgagagAAGucCACCAcgAUsU | 341 |

TABLE 1c-continued

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008380672-000E | 1663 | 1 | UCGUGGUGGACUUCUCUCA | B ucGuGGuGGAcuucucucAUsU B | 237 |
| R-008380672-000E | 1663 | 1 | UCGUGGUGGACUUCUCUCA | UgaGAGaAGUCCAcCacGaUsU | 409 |
| R-008380673-000N | 1663 | 1 | UCGUGGUGGACUUCUCUCA | uGAgAgAAguCCACCacGAUsU | 382 |
| R-008380673-000N | 1663 | 1 | UCGUGGUGGACUUCUCUCA | B ucGuGGuGGAcuucucucAUsU B | 237 |
| R-008380674-000X | 2670 | 4 | CCGAUCCAUACUGCGGAAC | guUCCGcAGuAUggaUCGgUsU | 344 |
| R-008380674-000X | 2670 | 4 | CCGAUCCAUACUGCGGAAC | B CCGAUCCAUACUGCGGAACUsU B | 222 |
| R-008380675-000F | 2669 | 3 | GCCGAUCCAUACUGCGGAA | uUcCgCAGUAuGGaUCGgCUsU | 328 |
| R-008380675-000F | 2669 | 3 | GCCGAUCCAUACUGCGGAA | B GCCGAUCCAUACUGCGGAAUsU B | 247 |
| R-008380676-000P | 2669 | 3 | GCCGAUCCAUACUGCGGAA | uUCcgCaGuAUggAUcGGCUsU | 292 |
| R-008380676-000P | 2669 | 3 | GCCGAUCCAUACUGCGGAA | B GccGAuccAuAcuGcGGAAUsU B | 224 |
| R-008380677-000Y | 2669 | 3 | GCCGAUCCAUACUGCGGAA | uucCgCAGuAUgGaUCGGCUsU | 330 |
| R-008380677-000Y | 2669 | 3 | GCCGAUCCAUACUGCGGAA | B GCCGAUCCAUACUGCGGAAUsU B | 226 |
| R-008380678-000G | 1665 | 2 | GUGGUGGACUUCUCUCAAU | auUgAGAGAaGUccacCaCUsU | 318 |
| R-008380678-000G | 1665 | 2 | GUGGUGGACUUCUCUCAAU | B GUGGUGGACUUCUCUCAAUUsU B | 257 |
| R-008380679-000R | 1665 | 2 | GUGGUGGACUUCUCUCAAU | aUUGAgAgaaGuCCAcCAcUsU | 360 |
| R-008380679-000R | 1665 | 2 | GUGGUGGACUUCUCUCAAU | B GuGGuGGAcuucucucAAuUsU B | 233 |
| R-008380680-000E | 1665 | 2 | GUGGUGGACUUCUCUCAAU | B GUGGUGGACUUCUCUCAAUUsU B | 250 |
| R-008380680-000E | 1665 | 2 | GUGGUGGACUUCUCUCAAU | AuugAgAgAAgUCcACCACUsU | 281 |
| R-008380681-000N | 2670 | 4 | CCGAUCCAUACUGCGGAAC | B CCGAUCCAUACUGCGGAACUsU B | 222 |
| R-008380681-000N | 2670 | 4 | CCGAUCCAUACUGCGGAAC | GuuCcGCaGUAUGgauCGGUsU | 309 |
| R-008380682-000X | 1663 | 1 | UCGUGGUGGACUUCUCUCA | B UCGUGGUGGACUUCUCUCAUsU B | 244 |
| R-008380682-000X | 1663 | 1 | UCGUGGUGGACUUCUCUCA | UGaGAGAaGUcCacCaCgAUsU | 287 |
| R-008380683-000F | 1663 | 1 | UCGUGGUGGACUUCUCUCA | B UCGUGGUGGACUUCUCUCAUsU B | 241 |
| R-008380683-000F | 1663 | 1 | UCGUGGUGGACUUCUCUCA | UgAGAgAAGuCCAcCaCGaUsU | 407 |
| R-008380684-000P | 2670 | 4 | CCGAUCCAUACUGCGGAAC | B CCGAUCCAUACUGCGGAACUsU B | 222 |
| R-008380684-000P | 2670 | 4 | CCGAUCCAUACUGCGGAAC | GuucCgCAgUAUGgAUCgGUsU | 275 |
| R-008380685-000Y | 2670 | 4 | CCGAUCCAUACUGCGGAAC | guUccGCaGUAUggAUCGgUsU | 384 |
| R-008380685-000Y | 2670 | 4 | CCGAUCCAUACUGCGGAAC | B CCGAUCCAUACUGCGGAACUsU B | 261 |
| R-008380686-000G | 2669 | 3 | GCCGAUCCAUACUGCGGAA | B GccGAuccAuAcuGcGGAAUsU B | 224 |
| R-008380686-000G | 2669 | 3 | GCCGAUCCAUACUGCGGAA | UucCGCaGUaUGGauCGGCUsU | 357 |
| R-008380687-000R | 2669 | 3 | GCCGAUCCAUACUGCGGAA | B GCCGAUCCAUACUGCGGAAUsU B | 247 |
| R-008380687-000R | 2669 | 3 | GCCGAUCCAUACUGCGGAA | UuCCgCAGUAugGaUcGGCUsU | 347 |
| R-008380688-000Z | 2669 | 3 | GCCGAUCCAUACUGCGGAA | B GCCGAUCCAUACUGCGGAAUsU B | 247 |
| R-008380688-000Z | 2669 | 3 | GCCGAUCCAUACUGCGGAA | UuCCGCAgUAUGGaUCGGcUsU | 375 |
| R-008380689-000H | 2669 | 3 | GCCGAUCCAUACUGCGGAA | uuCCgcagUauGGaUCGGCUsU | 376 |
| R-008380689-000H | 2669 | 3 | GCCGAUCCAUACUGCGGAA | B GccGAuccAuAcuGcGGAAUsU B | 224 |

TABLE 1c-continued

HBV siNA Strands Synthesized (Antisense sequences are readily identified as having complete or partial complementarity to the target sequence shown).

| siNA duplex ID | Target Site | SEQ ID NO: Target Sequence | Modified Sequence | SEQ ID NO: |
|---|---|---|---|---|
| R-008380690-000X | 2669 | 3 GCCGAUCCAUACUGCGGAA B | GCCGAUCCAUACUGCGGAAUsU B | 247 |
| R-008380690-000X | 2669 | 3 GCCGAUCCAUACUGCGGAA | UUCCGcAGUaUGgaucGgCUsU | 379 |
| R-008380691-000F | 2670 | 4 CCGAUCCAUACUGCGGAAC B | ccGAuccAuAcuGcGGAAcUsU B | 220 |
| R-008380691-000F | 2670 | 4 CCGAUCCAUACUGCGGAAC | GuuCCgCAGUAuggAUCGgUsU | 369 |
| R-008380692-000P | 1665 | 2 GUGGUGGACUUCUCUCAAU | aUUgagAGAAguCcACCAcUsU | 332 |
| R-008380692-000P | 1665 | 2 GUGGUGGACUUCUCUCAAU B | GuGGuGGAcuucucucAAuUsU B | 233 |
| R-008380693-000Y | 2670 | 4 CCGAUCCAUACUGCGGAAC B | ccGAuccAuAcuGcGGAAcUsU B | 220 |
| R-008380693-000Y | 2670 | 4 CCGAUCCAUACUGCGGAAC | GUUcCGCagUaugGAUcGgUsU | 313 |
| R-008380694-000G | 2670 | 4 CCGAUCCAUACUGCGGAAC | guUcCGCAguAuGgaUCGGUsU | 370 |
| R-008380694-000G | 2670 | 4 CCGAUCCAUACUGCGGAAC B | ccGAuccAuAcuGcGGAAcUsU B | 220 |
| R-008380695-000R | 2670 | 4 CCGAUCCAUACUGCGGAAC | gUuCcgCaGuauGgaUcGGUsU | 276 |
| R-008380695-000R | 2670 | 4 CCGAUCCAUACUGCGGAAC B | ccGAuccAuAcuGcGGAAcUsU B | 220 |
| R-008380696-000Z | 2669 | 3 GCCGAUCCAUACUGCGGAA B | GccGAuccAuAcuGcGGAAUsU B | 224 |
| R-008380696-000Z | 2669 | 3 GCCGAUCCAUACUGCGGAA | UUCcGCagUAuGGaUcGgCUsU | 327 |
| R-008380697-000H | 2669 | 3 GCCGAUCCAUACUGCGGAA B | GCCGAUCCAUACUGCGGAAUsU B | 226 |
| R-008380697-000H | 2669 | 3 GCCGAUCCAUACUGCGGAA | UUcCgCAGUauGGAUcggCUsU | 393 |
| R-008380698-000S | 2669 | 3 GCCGAUCCAUACUGCGGAA B | GccGAuccAuAcuGcGGAAUsU B | 224 |
| R-008380698-000S | 2669 | 3 GCCGAUCCAUACUGCGGAA | UucCgCAGUAuGgaUCgGcUsU | 349 |
| R-008380699-000A | 1665 | 2 GUGGUGGACUUCUCUCAAU B | GUGGUGGACUUCUCUCAAUUsU B | 250 |
| R-008380699-000A | 1665 | 2 GUGGUGGACUUCUCUCAAU | AUUgagAgAAGUcCAcCAcUsU | 359 |
| R-008380700-000A | 1665 | 2 GUGGUGGACUUCUCUCAAU B | GuGGuGGAcuucucucAAuUsU B | 233 |
| R-008380700-000A | 1665 | 2 GUGGUGGACUUCUCUCAAU | AUUGAgAgaaGUccacCACUsU | 321 |
| R-008380701-000J | 1665 | 2 GUGGUGGACUUCUCUCAAU | aUUgAGAAAgUCcACcaCUsU | 282 |
| R-008380701-000J | 1665 | 2 GUGGUGGACUUCUCUCAAU B | GUGGUGGACUUCUCUCAAUUsU B | 257 |
| R-008380702-000T | 1663 | 1 UCGUGGUGGACUUCUCUCA | uGAGAgAAgUCCacCACGAUsU | 334 |
| R-008380702-000T | 1663 | 1 UCGUGGUGGACUUCUCUCA B | UCGUGGUGGACUUCUCUCAUsU B | 244 |
| R-008380703-000B | 1663 | 1 UCGUGGUGGACUUCUCUCA B | UCGUGGUGGACUUCUCUCAUsU B | 241 |
| R-008380703-000B | 1663 | 1 UCGUGGUGGACUUCUCUCA | UGagAgAaGuCCAccaCGaUsU | 337 |
| R-008380704-000K | 1663 | 1 UCGUGGUGGACUUCUCUCA B | UCGUGGUGGACUUCUCUCAUsU B | 244 |
| R-008380704-000K | 1663 | 1 UCGUGGUGGACUUCUCUCA | UgaGagaAGUcCacCAcGaUsU | 413 |
| R-008380705-000U | 1663 | 1 UCGUGGUGGACUUCUCUCA B | UCGUGGUGGACUUCUCUCAUsU B | 241 |
| R-008380705-000U | 1663 | 1 UCGUGGUGGACUUCUCUCA | UGAgagaAGUcCAcCAcGAUsU | 367 |
| R-008380706-000C | 1663 | 1 UCGUGGUGGACUUCUCUCA | ugAgaGAaGUCCaCcaCGAUsU | 306 |
| R-008380706-000C | 1663 | 1 UCGUGGUGGACUUCUCUCA B | UCGUGGUGGACUUCUCUCAUsU B | 244 |
| R-008380707-000L | 2670 | 4 CCGAUCCAUACUGCGGAAC B | CCGAUCCAUACUGCGGAACUsU B | 261 |
| R-008380707-000L | 2670 | 4 CCGAUCCAUACUGCGGAAC | GUUCCGCAGUAUGgAUcgUsU | 311 |

TABLE 1c-continued

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008380708-000V | 2670 | 4 | CCGAUCCAUACUGCGGAAC | gUuCcGCAgUAUggAUcgGUsU | 342 |
| R-008380708-000V | 2670 | 4 | CCGAUCCAUACUGCGGAAC | B ccGAuccAuAcuGcGGAAcUsU B | 220 |
| R-008380709-000D | 2670 | 4 | CCGAUCCAUACUGCGGAAC | gUUccGCAGUaUGgAUCGgUsU | 388 |
| R-008380709-000D | 2670 | 4 | CCGAUCCAUACUGCGGAAC | B CCGAUCCAUACUGCGGAACUsU B | 222 |
| R-008380710-000T | 2669 | 3 | GCCGAUCCAUACUGCGGAA | uUCcGcAgUAUGgAUcggCUsU | 290 |
| R-008380710-000T | 2669 | 3 | GCCGAUCCAUACUGCGGAA | B GCCGAUCCAUACUGCGGAAUsU B | 247 |
| R-008380711-000B | 1665 | 2 | GUGGUGGACUUCUCUCAAU | auUGagaGaAGUCcaCcAcUsU | 362 |
| R-008380711-000B | 1665 | 2 | GUGGUGGACUUCUCUCAAU | B GuGGuGGAcuucucucAAuUsU B | 233 |
| R-008380712-000K | 1665 | 2 | GUGGUGGACUUCUCUCAAU | B GUGGUGGACUUCUCUCAAUUsU B | 257 |
| R-008380712-000K | 1665 | 2 | GUGGUGGACUUCUCUCAAU | AUugaGaGaAGuCcACCACUsU | 285 |
| R-008380713-000U | 2670 | 4 | CCGAUCCAUACUGCGGAAC | B CCGAUCCAUACUGCGGAACUsU B | 261 |
| R-008380713-000U | 2670 | 4 | CCGAUCCAUACUGCGGAAC | GuUCcgCAGuauGGaUCGUsU | 391 |
| R-008380714-000C | 2670 | 4 | CCGAUCCAUACUGCGGAAC | gUUCcgCAGUAUggaUCgGUsU | 372 |
| R-008380714-000C | 2670 | 4 | CCGAUCCAUACUGCGGAAC | B CCGAUCCAUACUGCGGAACUsU B | 261 |
| R-008380715-000L | 2669 | 3 | GCCGAUCCAUACUGCGGAA | uUCCGCAGUAUGGAUcggcUsU | 396 |
| R-008380715-000L | 2669 | 3 | GCCGAUCCAUACUGCGGAA | B GCCGAUCCAUACUGCGGAAUsU B | 247 |
| R-008380716-000V | 1665 | 2 | GUGGUGGACUUCUCUCAAU | B GUGGUGGACUUCUCUCAAUUsU B | 250 |
| R-008380716-000V | 1665 | 2 | GUGGUGGACUUCUCUCAAU | AuUGAgAGAAgucCaCCACUsU | 403 |
| R-008380717-000D | 1665 | 2 | GUGGUGGACUUCUCUCAAU | B GUGGUGGACUUCUCUCAAUUsU B | 257 |
| R-008380717-000D | 1665 | 2 | GUGGUGGACUUCUCUCAAU | AUuGaGAGAaGUCcacCACUsU | 353 |
| R-008380718-000M | 1665 | 2 | GUGGUGGACUUCUCUCAAU | B GUGGUGGACUUCUCUCAAUUsU B | 250 |
| R-008380718-000M | 1665 | 2 | GUGGUGGACUUCUCUCAAU | AuuGAgaGAaGUCcACCAcUsU | 323 |
| R-008380719-000W | 1665 | 2 | GUGGUGGACUUCUCUCAAU | aUuGAGAGaaGUccACCACUsU | 298 |
| R-008380719-000W | 1665 | 2 | GUGGUGGACUUCUCUCAAU | B GUGGUGGACUUCUCUCAAUUsU B | 250 |
| R-008380720-000K | 1663 | 1 | UCGUGGUGGACUUCUCUCA | ugagaGAAGUCcACcACgaUsU | 354 |
| R-008380720-000K | 1663 | 1 | UCGUGGUGGACUUCUCUCA | B ucGuGGuGGAcuucucucAUsU B | 237 |
| R-008380721-000U | 2670 | 4 | CCGAUCCAUACUGCGGAAC | gUUCcgCAGUaUGgAuCGGUsU | 314 |
| R-008380721-000U | 2670 | 4 | CCGAUCCAUACUGCGGAAC | B CCGAUCCAUACUGCGGAACUsU B | 222 |
| R-008380722-000C | 2670 | 4 | CCGAUCCAUACUGCGGAAC | gUUCCGCagUAUGgaucGGUsU | 386 |
| R-008380722-000C | 2670 | 4 | CCGAUCCAUACUGCGGAAC | B ccGAuccAuAcuGcGGAAcUsU B | 220 |
| R-008380723-000L | 2669 | 3 | GCCGAUCCAUACUGCGGAA | B GCCGAUCCAUACUGCGGAAUsU B | 226 |
| R-008380723-000L | 2669 | 3 | GCCGAUCCAUACUGCGGAA | UUcCgCAGuAUggauCGGCUsU | 399 |
| R-008380724-000V | 2669 | 3 | GCCGAUCCAUACUGCGGAA | B GCCGAUCCAUACUGCGGAAUsU B | 226 |
| R-008380724-000V | 2669 | 3 | GCCGAUCCAUACUGCGGAA | UUCcGCagUaUgGAUCGGcUsU | 295 |
| R-008380725-000D | 1665 | 2 | GUGGUGGACUUCUCUCAAU | B GuGGuGGAcuucucucAAuUsU B | 233 |
| R-008380725-000D | 1665 | 2 | GUGGUGGACUUCUCUCAAU | AuUGAGaGaaGUCCAccaCUsU | 401 |

TABLE 1c-continued

HBV siNA Strands Synthesized (Antisense sequences are readily identified as having complete or partial complementarity to the target sequence shown).

| siNA duplex ID | Target Site | SEQ ID NO:Target | Sequence | Modified Sequence | SEQ ID NO: |
|---|---|---|---|---|---|
| R-008380726-000M | 1665 | 2 | GUGGUGGACUUCUCUCAAU | auuGAGaGAagUCCAcCACUsU | 350 |
| R-008380726-000M | 1665 | 2 | GUGGUGGACUUCUCUCAAU | B GUGGUGGACUUCUCUCAAUUsU B | 257 |
| R-008380727-000W | 2669 | 3 | GCCGAUCCAUACUGCGGAA | B gCCgAUCCAUaCUgCgAAUsU B | 374 |
| R-008380727-000W | 2669 | 3 | GCCGAUCCAUACUGCGGAA | UUCCgCagUaUggaUCggCUsU | 227 |
| R-008380728-000E | 2669 | 3 | GCCGAUCCAUACUGCGGAA | uuccGcAGuAuGGAucGGcUsU | 228 |
| R-008380728-000E | 2669 | 3 | GCCGAUCCAUACUGCGGAA | B GCCGAUCcauACUgCGgaAUsU B | 378 |
| R-008380729-000N | 1665 | 2 | GUGGUGGACUUCUCUCAAU | B GUgGUGGAcUUCUCuCAaUUsU B | 351 |
| R-008380729-000N | 1665 | 2 | GUGGUGGACUUCUCUCAAU | AUUGAGAGAAGuccAccAcUsU | 259 |
| R-008380730-000C | 1665 | 2 | GUGGUGGACUUCUCUCAAU | B gUGguGgaCUuCUCUCAauUsU B | 361 |
| R-008380730-000C | 1665 | 2 | GUGGUGGACUUCUCUCAAU | AUUGAGAGAAGUCCACCACUsU | 256 |
| R-008380731-000L | 1665 | 2 | GUGGUGGACUUCUCUCAAU | B gUGGUGGACUUCUcUCaAUUsU B | 300 |
| R-008380731-000L | 1665 | 2 | GUGGUGGACUUCUCUCAAU | AuuGAGAGAAGuccAccAcUsU | 234 |
| R-008380732-000V | 1663 | 1 | UCGUGGUGGACUUCUCUCA | B UCGUGGUGgACuuCUCUCAUsU B | 335 |
| R-008380732-000V | 1663 | 1 | UCGUGGUGGACUUCUCUCA | UGAGAGAAGuccAccAcGAUsU | 239 |
| R-008380733-000D | 1663 | 1 | UCGUGGUGGACUUCUCUCA | uGAGAGAAGuccAccAcGAUsU | 243 |
| R-008380733-000D | 1663 | 1 | UCGUGGUGGACUUCUCUCA | B uCGUggugGACUUCUCuCAUsU B | 305 |
| R-008380734-000M | 2670 | 4 | CCGAUCCAUACUGCGGAAC | B CCGaUCCAUaCuGCGgAAcUsU B | 289 |
| R-008380734-000M | 2670 | 4 | CCGAUCCAUACUGCGGAAC | GUUccGcAGuAuGGAucGGUsU | 246 |
| R-008380735-000W | 2670 | 4 | CCGAUCCAUACUGCGGAAC | B cCGAUCCauACUGCgGAACUsU B | 277 |
| R-008380735-000W | 2670 | 4 | CCGAUCCAUACUGCGGAAC | GuuccGcAGuAuGGAucGGUsU | 223 |
| R-008380736-000E | 2669 | 3 | GCCGAUCCAUACUGCGGAA | B gCCgaUCCaUaCUgCggaaUsU B | 326 |
| R-008380736-000E | 2669 | 3 | GCCGAUCCAUACUGCGGAA | UUCCgCagUaUggaUCggCUsU | 225 |
| R-008380737-000N | 2669 | 3 | GCCGAUCCAUACUGCGGAA | B gCCgaUCCaUaCUgCGgAAUsU B | 394 |
| R-008380737-000N | 2669 | 3 | GCCGAUCCAUACUGCGGAA | UUCCGCAGUAUGGAUCGGCUsU | 267 |
| R-008380738-000X | 2669 | 3 | GCCGAUCCAUACUGCGGAA | uuccGcAGuAuGGAucGGcUsU | 228 |
| R-008380738-000X | 2669 | 3 | GCCGAUCCAUACUGCGGAA | B GCCGAuCCaUACUgCGGAAUsU B | 331 |
| R-008380739-000F | 1665 | 2 | GUGGUGGACUUCUCUCAAU | B GUGGUGGACUUcUcUCaaUUsU B | 402 |
| R-008380739-000F | 1665 | 2 | GUGGUGGACUUCUCUCAAU | AUUgagagaagUCCaCCaCUsU | 263 |
| R-008380740-000V | 1665 | 2 | GUGGUGGACUUCUCUCAAU | B GUGGUGgACUUcUCUCAAUUsU B | 280 |
| R-008380740-000V | 1665 | 2 | GUGGUGGACUUCUCUCAAU | AUUGAGAGAAGUCCACCACUsU | 256 |
| R-008380741-000D | 1663 | 1 | UCGUGGUGGACUUCUCUCA | B UCgUggUgGAcUUCUCUCAUsU B | 408 |
| R-008380741-000D | 1663 | 1 | UCGUGGUGGACUUCUCUCA | UGAGAGAAGUCCACCACGAUsU | 260 |
| R-008380742-000M | 1663 | 1 | UCGUGGUGGACUUCUCUCA | B ucgUgGUgGaCUuCUCUCaUsU B | 383 |
| R-008380742-000M | 1663 | 1 | UCGUGGUGGACUUCUCUCA | UGAgagaagUCCaCCaCgaUsU | 242 |
| R-008380743-000W | 2670 | 4 | CCGAUCCAUACUGCGGAAC | B CCGaUCCAUACUGCGgaACUsU B | 343 |
| R-008380743-000W | 2670 | 4 | CCGAUCCAUACUGCGGAAC | GUUCCGCAGUAUGGAUCGGUsU | 254 |

TABLE 1c-continued

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008380744-000E | 2670 | 4 | CCGAUCCAUACUGCGGAAC | B CCgAUCCaUaCUgcGgAaCUsU B | 274 |
| R-008380744-000E | 2670 | 4 | CCGAUCCAUACUGCGGAAC | GUUCCGCAGUAUGGAUCGGUsU | 254 |
| R-008380745-000N | 2670 | 4 | CCGAUCCAUACUGCGGAAC | B CCgaUCCAuacUgcggaACUsU B | 324 |
| R-008380745-000N | 2670 | 4 | CCGAUCCAUACUGCGGAAC | GUUCCGCAGUAUGGAUCGGUsU | 254 |
| R-008380746-000X | 2670 | 4 | CCGAUCCAUACUGCGGAAC | B CCgAUcCaUACUgCGgAACUsU B | 385 |
| R-008380746-000X | 2670 | 4 | CCGAUCCAUACUGCGGAAC | GUUCCGCAGUAUGGAUCGGUsU | 221 |
| R-008380747-000F | 2670 | 4 | CCGAUCCAUACUGCGGAAC | B CcGaUCCAUaCUGCGGAaCUsU B | 373 |
| R-008380747-000F | 2670 | 4 | CCGAUCCAUACUGCGGAAC | GuuccGcAGuAuGGAucGGUsU | 223 |
| R-008380748-000P | 1665 | 2 | GUGGUGGACUUCUCUCAAU | B GuGgUgGACUUcUCUcaAUUsU B | 358 |
| R-008380748-000P | 1665 | 2 | GUGGUGGACUUCUCUCAAU | AUUGAGAGAAGuccAccAcUsU | 259 |
| R-008380749-000Y | 1665 | 2 | GUGGUGGACUUCUCUCAAU | B gUggUggaCUUCUCUCaaUUsU B | 320 |
| R-008380749-000Y | 1665 | 2 | GUGGUGGACUUCUCUCAAU | AUUGAGAGAAGUCCACCACUsU | 268 |
| R-008380750-000M | 1665 | 2 | GUGGUGGACUUCUCUCAAU | B GUGGUggACUuCUCUCAAUUsU B | 299 |
| R-008380750-000M | 1665 | 2 | GUGGUGGACUUCUCUCAAU | AUUgagagaagUCCaCCaCUsU | 251 |
| R-008380751-000W | 1663 | 1 | UCGUGGUGGACUUCUCUCA | B UCgUGgUgGACUUcUcUCaUsU B | 406 |
| R-008380751-000W | 1663 | 1 | UCGUGGUGGACUUCUCUCA | UGAgagaagUCCaCCaCgaUsU | 238 |
| R-008380752-000E | 2670 | 4 | CCGAUCCAUACUGCGGAAC | B CcGAUCCAUACUgcGgaACUsU B | 308 |
| R-008380752-000E | 2670 | 4 | CCGAUCCAUACUGCGGAAC | GUUCCgCagUaUggaUCggUsU | 266 |
| R-008380753-000N | 2670 | 4 | CCGAUCCAUACUGCGGAAC | B CCGAUCCAUACUGCGGAaCUsU B | 312 |
| R-008380753-000N | 2670 | 4 | CCGAUCCAUACUGCGGAAC | GUUccGcAGuAuGGAucGGUsU | 246 |
| R-008380754-000X | 2670 | 4 | CCGAUCCAUACUGCGGAAC | B CCgAUcCAuACUGCgGaACUsU B | 371 |
| R-008380754-000X | 2670 | 4 | CCGAUCCAUACUGCGGAAC | GUUCCGCAGUAUGGAUCGGUsU | 221 |
| R-008380755-000F | 2669 | 3 | GCCGAUCCAUACUGCGGAA | B GCCGAuCCAUaCuGCGgaaUsU B | 291 |
| R-008380755-000F | 2669 | 3 | GCCGAUCCAUACUGCGGAA | UUCCgCagUaUggaUCggCUsU | 225 |
| R-008380756-000P | 2669 | 3 | GCCGAUCCAUACUGCGGAA | B GCCgaUCCaUACUGCGgaAUsU B | 279 |
| R-008380756-000P | 2669 | 3 | GCCGAUCCAUACUGCGGAA | UUCCgCagUaUggaUCggCUsU | 225 |
| R-008380757-000Y | 2669 | 3 | GCCGAUCCAUACUGCGGAA | B GCCgAUCCAUACUGCGGAAUsU B | 398 |
| R-008380757-000Y | 2669 | 3 | GCCGAUCCAUACUGCGGAA | UUCCGCAGUAUGGAUCGGCUsU | 248 |
| R-008380758-000G | 2669 | 3 | GCCGAUCCAUACUGCGGAA | uuccGcAGuAuGGAucGGcUsU | 228 |
| R-008380758-000G | 2669 | 3 | GCCGAUCCAUACUGCGGAA | B GCCGAUCCAUACUgCGgaaUsU B | 377 |
| R-008380759-000R | 1665 | 2 | GUGGUGGACUUCUCUCAAU | B GUGgUGgaCUUCUCUCaaUUsU B | 284 |
| R-008380759-000R | 1665 | 2 | GUGGUGGACUUCUCUCAAU | AuuGAGAGAAGuccAccAcUsU | 234 |
| R-008380760-000E | 1663 | 1 | UCGUGGUGGACUUCUCUCA | B UCgUGGUGGACUUCUCUcaUsU B | 340 |
| R-008380760-000E | 1663 | 1 | UCGUGGUGGACUUCUCUCA | UGAGAGAAGUCCACCACGAUsU | 240 |
| R-008380761-000N | 2670 | 4 | CCGAUCCAUACUGCGGAAC | B CCgaUCCaUaCUgCggaaCUsU B | 389 |
| R-008380761-000N | 2670 | 4 | CCGAUCCAUACUGCGGAAC | GUUCCgCagUaUggaUCggUsU | 255 |

TABLE 1c-continued

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008380762-000X | 2669 | 3 | GCCGAUCCAUACUGCGGAA B | GCcgaUCC<u>A</u>Ua<u>CUgCGG</u>aA<u>U</u>sU B | 356 |
| R-008380762-000X | 2669 | 3 | GCCGAUCCAUACUGCGGAA | UUCc<u>G</u>c<u>AGU</u>A<u>U</u><u>GG</u>Auc<u>GG</u>c<u>U</u>sU | 230 |
| R-008380763-000F | 1665 | 2 | GUGGUGGACUUCUCUCAAU B | g<u>U</u>g<u>gU</u><u>GGACUUCU</u>C<u>U</u><u>CA</u>A<u>U</u>UsU B | 352 |
| R-008380763-000F | 1665 | 2 | GUGGUGGACUUCUCUCAAU | AUUGAGAGAAG<u>U</u>CC<u>A</u>CC<u>A</u>C<u>U</u>sU | 256 |
| R-008380764-000P | 1665 | 2 | GUGGUGGACUUCUCUCAAU B | g<u>U</u>ggUgg<u>A</u>cuU<u>CUCU</u>CAa<u>UU</u>sU B | 333 |
| R-008380764-000P | 1665 | 2 | GUGGUGGACUUCUCUCAAU | AUUgagagaagUCCaCCaC<u>U</u>sU | 251 |
| R-008380765-000Y | 1665 | 2 | GUGGUGGACUUCUCUCAAU B | <u>GU</u>GgUgGa<u>CUU</u>CU<u>CU</u>CA<u>AUU</u>sU B | 405 |
| R-008380765-000Y | 1665 | 2 | GUGGUGGACUUCUCUCAAU | AUUgagagaagUCCaCCaC<u>U</u>sU | 251 |
| R-008380766-000G | 1663 | 1 | UCGUGGUGGACUUCUCUCA B | UCGUGgUggACUUCUCUCAUsU B | 364 |
| R-008380766-000G | 1663 | 1 | UCGUGGUGGACUUCUCUCA | U<u>GAGAGAAG</u>ucc<u>A</u>cc<u>A</u>c<u>GAU</u>sU | 239 |
| R-008380767-000R | 1663 | 1 | UCGUGGUGGACUUCUCUCA | uGAGAGAAGuccAccAcGA<u>U</u>sU | 243 |
| R-008380767-000R | 1663 | 1 | UCGUGGUGGACUUCUCUCA B | <u>UCG</u>ugg<u>U</u>Gga<u>CUU</u>Cuc<u>U</u>CA<u>U</u>sU B | 307 |
| R-008380768-000Z | 2670 | 4 | CCGAUCCAUACUGCGGAAC B | <u>CC</u>GAU<u>CC</u>aUa<u>C</u>Ug<u>C</u>g<u>GA</u>a<u>CU</u>sU B | 368 |
| R-008380768-000Z | 2670 | 4 | CCGAUCCAUACUGCGGAAC | GUU<u>CC</u>g<u>C</u>ag<u>U</u>a<u>U</u>gga<u>UC</u>gg<u>U</u>sU | 266 |
| R-008380769-000H | 2669 | 3 | GCCGAUCCAUACUGCGGAA B | <u>GCC</u>Ga<u>UCCAUACUGCGG</u>Aa<u>U</u>sU B | 348 |
| R-008380769-000H | 2669 | 3 | GCCGAUCCAUACUGCGGAA | UU<u>CCGCAGUAUGGAUCGGCU</u>sU | 248 |
| R-008380770-000X | 2669 | 3 | GCCGAUCCAUACUGCGGAA B | G<u>cc</u>ga<u>UCC</u>a<u>U</u>A<u>CUGC</u>g<u>G</u>AA<u>U</u>sU B | 329 |
| R-008380770-000X | 2669 | 3 | GCCGAUCCAUACUGCGGAA | UU<u>CCGCAGUAUGGAUCGGCU</u>sU | 248 |
| R-008380771-000F | 1665 | 2 | GUGGUGGACUUCUCUCAAU B | g<u>UGGU</u>G<u>G</u>a<u>CUUCUCU</u>CAa<u>UU</u>sU B | 322 |
| R-008380771-000F | 1665 | 2 | GUGGUGGACUUCUCUCAAU | AUU<u>GAGAGAAGU</u>CC<u>A</u>CC<u>A</u>C<u>U</u>sU | 268 |
| R-008380772-000P | 1663 | 1 | UCGUGGUGGACUUCUCUCA B | <u>UC</u>g<u>U</u>gg<u>U</u>gga<u>CUUCUCUC</u>a<u>U</u>sU B | 380 |
| R-008380772-000P | 1663 | 1 | UCGUGGUGGACUUCUCUCA | UGAgagaag<u>U</u>CC<u>A</u>CC<u>A</u>Cga<u>U</u>sU | 238 |
| R-008380773-000Y | 1663 | 1 | UCGUGGUGGACUUCUCUCA B | <u>UC</u>g<u>U</u>g<u>GU</u>g<u>G</u>A<u>CUUCUCUC</u>A<u>U</u>sU B | 336 |
| R-008380773-000Y | 1663 | 1 | UCGUGGUGGACUUCUCUCA | U<u>GAGAGAAG</u>ucc<u>A</u>cc<u>A</u>c<u>GAU</u>sU | 239 |
| R-008380774-000G | 1663 | 1 | UCGUGGUGGACUUCUCUCA B | U<u>CGUGGU</u>Gga<u>CUUCUCUCAU</u>sU B | 355 |
| R-008380774-000G | 1663 | 1 | UCGUGGUGGACUUCUCUCA | UGAGAGAAG<u>U</u>CC<u>A</u>CC<u>A</u>CGA<u>U</u>sU | 240 |
| R-008380775-000R | 1663 | 1 | UCGUGGUGGACUUCUCUCA B | U<u>CGU</u>gg<u>u</u>G<u>G</u>a<u>CUU</u>c<u>U</u>C<u>UC</u>a<u>U</u>sU B | 411 |
| R-008380775-000R | 1663 | 1 | UCGUGGUGGACUUCUCUCA | UGA<u>GAGAAGU</u>CC<u>A</u>CC<u>A</u>CGA<u>U</u>sU | 260 |
| R-008380776-000Z | 1663 | 1 | UCGUGGUGGACUUCUCUCA B | <u>UC</u>g<u>U</u>gg<u>U</u>g<u>G</u>A<u>CUUCUCU</u>ca<u>U</u>sU B | 366 |
| R-008380776-000Z | 1663 | 1 | UCGUGGUGGACUUCUCUCA | UGAgagaagUCCaCCaCga<u>U</u>sU | 242 |
| R-008380777-000H | 1663 | 1 | UCGUGGUGGACUUCUCUCA | uGAGAGAAGuccAccAcGA<u>U</u>sU | 243 |
| R-008380777-000H | 1663 | 1 | UCGUGGUGGACUUCUCUCA B | <u>UCGU</u>Gg<u>U</u>g<u>G</u>A<u>CU</u>u<u>C</u>u<u>CUCAU</u>sU B | 415 |
| R-008380778-000S | 2670 | 4 | CCGAUCCAUACUGCGGAAC B | <u>CCG</u>a<u>UCCAUACUGC</u>gga<u>ACU</u>sU B | 315 |
| R-008380778-000S | 2670 | 4 | CCGAUCCAUACUGCGGAAC | GUU<u>CCGCAGUAUGGAUCGGU</u>sU | 221 |
| R-008380779-000A | 2670 | 4 | CCGAUCCAUACUGCGGAAC B | c<u>CG</u>a<u>UCC</u>a<u>U</u>A<u>CUGC</u>gg<u>AACU</u>sU B | 390 |
| R-008380779-000A | 2670 | 4 | CCGAUCCAUACUGCGGAAC | GUU<u>CC</u>g<u>C</u>ag<u>U</u>a<u>U</u>gga<u>UC</u>gg<u>U</u>sU | 255 |

TABLE 1c-continued

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008380780-000P | 2669 | 3 | GCCGAUCCAUACUGCGGAA B | GcCgAUCCAUaCUgcGgaAUsU B | 346 |
| R-008380780-000P | 2669 | 3 | GCCGAUCCAUACUGCGGAA | UUCcGcAGuAuGGAucGGcUsU | 230 |
| R-008380781-000Y | 2669 | 3 | GCCGAUCCAUACUGCGGAA B | gcCGAUCCAUACUGCGGAaUsU B | 293 |
| R-008380781-000Y | 2669 | 3 | GCCGAUCCAUACUGCGGAA | UUCCgCagUaUggaUCggCUsU | 227 |
| R-008380782-000G | 2669 | 3 | GCCGAUCCAUACUGCGGAA B | GcCGAUCCAUACUGCGGaAUsU B | 294 |
| R-008380782-000G | 2669 | 3 | GCCGAUCCAUACUGCGGAA | UUCCgCagUaUggaUCggCUsU | 227 |
| R-008380783-000R | 1665 | 2 | GUGGUGGACUUCUCUCAAU B | GugGUGgaCUUCUCUcAAUUsU B | 400 |
| R-008380783-000R | 1665 | 2 | GUGGUGGACUUCUCUCAAU | AUUgagagaagUCCaCCaCUsU | 263 |
| R-008380784-000Z | 1665 | 2 | GUGGUGGACUUCUCUCAAU B | GUggUggACUUCuCuCaaUUsU B | 319 |
| R-008380784-000Z | 1665 | 2 | GUGGUGGACUUCUCUCAAU | AUUgagagaagUCCaCCaCUsU | 263 |
| R-008380785-000H | 1665 | 2 | GUGGUGGACUUCUCUCAAU B | GUGgUGaCUUCUCUCAAUUsU B | 283 |
| R-008380785-000H | 1665 | 2 | GUGGUGGACUUCUCUCAAU | AUUGAGAGAAGUCCACCACUsU | 268 |
| R-008380786-000S | 2670 | 4 | CCGAUCCAUACUGCGGAAC B | CCGAUCCAUaCuGCGGAaCUsU B | 310 |
| R-008380786-000S | 2670 | 4 | CCGAUCCAUACUGCGGAAC | GUUCCgCagUaUggaUCggUsU | 266 |
| R-008380787-000A | 2670 | 4 | CCGAUCCAUACUGCGGAAC B | CCGAUCCAUaCUgCggAACUsU B | 272 |
| R-008380787-000A | 2670 | 4 | CCGAUCCAUACUGCGGAAC | GUUccGcAGuAuGGAucGGUsU | 246 |
| R-008380788-000J | 2670 | 4 | CCGAUCCAUACUGCGGAAC B | CCgAUCCAUACUGCGgaaCUsU B | 387 |
| R-008380788-000J | 2670 | 4 | CCGAUCCAUACUGCGGAAC | GUUCCgCagUaUggaUCggUsU | 255 |
| R-008380789-000T | 2670 | 4 | CCGAUCCAUACUGCGGAAC B | CCgAUCcaUaCugCGGAACUsU B | 345 |
| R-008380789-000T | 2670 | 4 | CCGAUCCAUACUGCGGAAC | GuuccGcAGuAuGGAucGGUsU | 223 |
| R-008380790-000G | 2669 | 3 | GCCGAUCCAUACUGCGGAA B | gCCGaUCCaUACUGCggAaUsU B | 392 |
| R-008380790-000G | 2669 | 3 | GCCGAUCCAUACUGCGGAA | UUCcGcAGuAuGGAucGGcUsU | 230 |
| R-008380791-000R | 2669 | 3 | GCCGAUCCAUACUGCGGAA B | GCCGAUCCAUACUgCgGAAUsU B | 397 |
| R-008380791-000R | 2669 | 3 | GCCGAUCCAUACUGCGGAA | UUCCGCAGUAUGGAUCGGCUsU | 267 |
| R-008380792-000Z | 2669 | 3 | GCCGAUCCAUACUGCGGAA B | GCCgaUCCAUACUgCGGaaUsU B | 316 |
| R-008380792-000Z | 2669 | 3 | GCCGAUCCAUACUGCGGAA | UUCCGCAGUAUGGAUCGGCUsU | 267 |
| R-008380793-000H | 1665 | 2 | GUGGUGGACUUCUCUCAAU B | GUgGUGGaCUUCUCUcaaUUsU B | 296 |
| R-008380793-000H | 1665 | 2 | GUGGUGGACUUCUCUCAAU | AUUGAGAGAAGuccAccAcUsU | 259 |
| R-008380794-000S | 1665 | 2 | GUGGUGGACUUCUCUCAAU B | gUgGuggACUUCUCUCaAUUsU B | 363 |
| R-008380794-000S | 1665 | 2 | GUGGUGGACUUCUCUCAAU | AuuGAGAGAAGuccAccAcUsU | 234 |
| R-008380795-000A | 1663 | 1 | UCGUGGUGGACUUCUCUCA B | UCGUGGUggaCuUCUCUCaUsU B | 286 |
| R-008380795-000A | 1663 | 1 | UCGUGGUGGACUUCUCUCA | UGAgagaagUCCaCCaCgaUsU | 238 |
| R-008380796-000J | 1663 | 1 | UCGUGGUGGACUUCUCUCA B | UCgugGUGGACUUCUCUcAUsU B | 338 |
| R-008380796-000J | 1663 | 1 | UCGUGGUGGACUUCUCUCA | UGAGAGAAGUCCACCACGAUsU | 240 |
| R-008380797-000T | 1663 | 1 | UCGUGGUGGACUUCUCUCA B | UCgUGGUGGaCUUCuCUCAUsU B | 302 |
| R-008380797-000T | 1663 | 1 | UCGUGGUGGACUUCUCUCA | UGAGAGAAGUCCACCACGAUsU | 260 |

TABLE 1c-continued

HBV siNA Strands Synthesized (Antisense sequences are readily identified as having complete or partial complementarity to the target sequence shown).

| siNA duplex ID | Target Site | SEQ ID NO: | Target Sequence | Modified Sequence | SEQ ID NO: |
|---|---|---|---|---|---|
| R-008380798-000B | 1663 | 1 | UCGUGGUGGACUUCUCUCA B | uCGuGGUgGaCUUCUCUcAUsU B | 412 |
| R-008380798-000B | 1663 | 1 | UCGUGGUGGACUUCUCUCA | UGAgagaagUCCaCCaCgaUsU | 242 |
| R-008418316-000S | 1662 | 43 | CUCGUGGUGGACUUCUCUC B | cucGuGGuGGAcuucucucUsU B | 416 |
| R-008418316-000S | 1662 | 43 | CUCGUGGUGGACUUCUCUC | GAGAGAAGuccAccAcGAGUsU | 417 |
| R-008418319-000T | 2046 | 44 | CCUAUGGGAGUGGGCCUCA B | ccuAuGGGAGuGGGccucAUsU B | 418 |
| R-008418319-000T | 2046 | 44 | CCUAUGGGAGUGGGCCUCA | UGAGGcccAcucccAuAGGUsU | 419 |
| R-008418328-000B | 568 | 45 | AAGAACUCCCUCGCCUCGC B | AAGAAcucccucGccucGcUsU B | 420 |
| R-008418328-000B | 568 | 45 | AAGAACUCCCUCGCCUCGC | GCGAGGcGAGGGAGuucuuUsU | 421 |
| R-008418337-000K | 2666 | 46 | UCUGCCGAUCCAUACUGCG B | ucuGccGAuccAuAcuGcGUsU B | 422 |
| R-008418337-000K | 2666 | 46 | UCUGCCGAUCCAUACUGCG | CGCAGuAuGGAucGGcAGAUsU | 423 |
| R-008418340-000S | 1652 | 47 | AGAGUCUAGACUCGUGGUG B | AGAGucuAGAcucGuGGuGUsU B | 424 |
| R-008418340-000S | 1652 | 47 | AGAGUCUAGACUCGUGGUG | CACcAcGAGucuAGAcucuUsU | 425 |
| R-008418343-000T | 564 | 48 | GAAGAAGAACUCCCUCGCC B | GAAGAAGAAcucccucGccUsU B | 426 |
| R-008418343-000T | 564 | 48 | GAAGAAGAACUCCCUCGCC | GGCGAGGGAGuucuucuucUsU | 427 |
| R-008418355-000C | 52 | 49 | UCAAGCCUCCAAGCUGUGC B | ucAAGccuccAAGcuGuGcUsU B | 428 |
| R-008418355-000C | 52 | 49 | UCAAGCCUCCAAGCUGUGC | GCAcAGcuuGGAGGcuuGAUsU | 429 |
| R-008418358-000D | 55 | 50 | AGCCUCCAAGCUGUGCCUU B | AGccuccAAGcuGuGccuuUsU B | 430 |
| R-008418358-000D | 55 | 50 | AGCCUCCAAGCUGUGCCUU | AAGGcAcAGcuuGGAGGcuUsU | 431 |
| R-008418361-000K | 1659 | 51 | AGACUCGUGGUGGACUUCU B | AGAcucGuGGuGGAcuucuUsU B | 432 |
| R-008418361-000K | 1659 | 51 | AGACUCGUGGUGGACUUCU | AGAAGuccAccAcGAGucuUsU | 433 |
| R-008418313-000R | 564 | 48 | GAAGAAGAACUCCCUCGCC B | GAAGAAGAACUCCCUCGCCUsU B | 434 |
| R-008418313-000R | 564 | 48 | GAAGAAGAACUCCCUCGCC | GGCGAGGGAGUUCUUCUUCUsU | 435 |
| R-008418322-000Z | 1659 | 51 | AGACUCGUGGUGGACUUCU B | AGACUCGUGGUGGACUUCUUsU B | 436 |
| R-008418322-000Z | 1659 | 51 | AGACUCGUGGUGGACUUCU | AGAAGUCCACCACGAGUCUUsU | 437 |
| R-008418325-000A | 2666 | 46 | UCUGCCGAUCCAUACUGCG B | UCUGCCGAUCCAUACUGCGUsU B | 438 |
| R-008418325-000A | 2666 | 46 | UCUGCCGAUCCAUACUGCG | CGCAGUAUGGAUCGGCAGAUsU | 439 |
| R-008418331-000H | 568 | 45 | AAGAACUCCCUCGCCUCGC B | AAGAACUCCCUCGCCUCGCUsU B | 440 |
| R-008418331-000H | 568 | 45 | AAGAACUCCCUCGCCUCGC | GCGAGGCGAGGGAGUUCUUUsU | 441 |
| R-008418334-000J | 52 | 49 | UCAAGCCUCCAAGCUGUGC B | UCAAGCCUCCAAGCUGUGCUsU B | 442 |
| R-008418334-000J | 52 | 49 | UCAAGCCUCCAAGCUGUGC | GCACAGCUUGGAGGCUUGAUsU | 443 |
| R-008418346-000U | 55 | 50 | AGCCUCCAAGCUGUGCCUU B | AGCCUCCAAGCUGUGCCUUUsU B | 444 |
| R-008418346-000U | 55 | 50 | AGCCUCCAAGCUGUGCCUU | AAGGCACAGCUUGGAGGCUUsU | 445 |
| R-008418349-000V | 1662 | 43 | CUCGUGGUGGACUUCUCUC B | CUCGUGGUGGACUUCUCUCUsU B | 446 |
| R-008418349-000V | 1662 | 43 | CUCGUGGUGGACUUCUCUC | GAGAGAAGUCCACCACGAGUsU | 447 |
| R-008418352-000B | 2046 | 44 | CCUAUGGGAGUGGGCCUCA B | CCUAUGGGAGUGGGCCUCAUsU B | 448 |
| R-008418352-000B | 2046 | 44 | CCUAUGGGAGUGGGCCUCA | UGAGGCCCACUCCCAUAGGUsU | 449 |

TABLE 1c-continued

HBV siNA Strands Synthesized (Antisense sequences are readily
identified as having complete or partial complementarity to the
target sequence shown).

| siNA duplex ID | Target Site | SEQ ID NO: | Target Sequence | Modified Sequence | SEQ ID NO: |
|---|---|---|---|---|---|
| R-008418364-000L | 1652 | 47 | AGAGUCUAGACUCGUGGUG | B AGAGUCUAGACUCGUGGUGUsU B | 450 |
| R-008418364-000L | 1652 | 47 | AGAGUCUAGACUCGUGGUG | CACCACGAGUCUAGACUCUUsU | 451 | wherein:
A, C, G, and U = ribose A, C, G or U
a, g, c and u = 2'-deoxy-2'-fluoro A, G, C or U
A, U, C and G = 2'-O-methyl (2'-OMe) A, U, C, or G
A, U, C, and G = deoxy A, U, C, or G
B = inverted abasic
T = thymidine
s = phosphorothioate linkage Further Synthesis Steps for Commercial Preparation Once analysis indicates that the target product purity has been achieved after the annealing step, the material is transferred to the tangential flow filtration (TFF) system for concentration and desalting, as opposed to doing this prior to the annealing step.

Ultrafiltration:

The annealed product solution is concentrated using a TFF system containing an appropriate molecular weight cut-off membrane. Following concentration, the product solution is desalted via diafiltration using Milli-Q water until the conductivity of the filtrate is that of water.

Lyophilization:

The concentrated solution is transferred to a bottle, flash frozen and attached to a lyophilizer. The product is then freeze-dried to a powder. The bottle is removed from the lyophilizer and is now ready for use.

Initial Screening Protocol (96-Well Plate Transfections)

Cell Culture Preparation:

Human hepatoma cell line, HepG2, or mouse hepatoma cell line, Hepa1-6, were grown in modified Eagle's medium. All the culture media were supplemented with 10% fetal bovine serum, 100 µg/mL streptomycin, 100 U/mL penicillin, and 1% sodium bicarbonate.

Transfection and Screening

A plasmid (pSiCheck-HepB-Partial, Ref ID:1104) was generated where a partial HBV genome was inserted in to the pSiCheck2 plasmid (Promega, Madison, Wis.) at the XhoI/NotI sites downstream of the *Renilla Luciferase* gene. The *Renilla Luciferase* mRNA transcript is then expressed upstream of the HBV transcript and therefore, siNAS targeted against HBV genome that cause knockdown of the HBV transcript will also result in knockdown of the *Renilla Luciferase* transcript. The level of *Renilla Luciferase* transcript can be determined by directly mestuing the amount of *Renilla Luciferase* activity. The plasmid also expresses the Firefly Luciferase gene that is unaffected by the HBV siNAs and can be used to normalize the data to take into account any variations in the amount of plasmid transfected into cells.

The partial HBV genome consisted of 2270 nts of the adw2 genotype A HBV virus (nts 158-2427 where EcoRI site is nt1).

```
Partial HBV DNA sequence (SEQ ID NO: 503):
gagaacatcacatcaggatccctaggaccctgctcgtgttacaggcggggttttcttgttgacaagaatcctcacaataccgcagagtctc gactcgtggtggacttctctcaatttctaggggatcacccgtgtgtcttggccaaaattcgcagtccccaacctccaatcactcaccaacct cctgtcctccaatttgtcctggttatcgctggatgtgtctgcggcgttttatcatattcctcttcatcctgctgctatgcctcatcttcttattggtactt ctggattatcaaggtatgttgcccgtttgtcctctaattccaggaaccacaacaaccagtacgggaccctgcaaaacctgcacgactcctgct caaggcaactctatgtttccctcatgttgctgtacaaaacctacggatggaaattgcacctgtattcccatcccatcatcttgggctttcgcaaaa tacctatgggaatgggcctcagtccgtttctcatggctcagttcactagtgccatttgttcagtggttcgtagggctttcccccactgtttggcttt cagttatgtggatgatgtggtattgggggccaagtctgtacaacatcttgagtccctttataccgctattaccaattttcttttgtctttgggtataca tctaaaccctaacaaaacaaagagatggggttactccctaaacttcatgggatatgtaattggaagttggggaacattaccacaggatcatatt gtacaaaaacttaaacactgttttagaaaacttcctgttaataggcctattgattggaaagtatgtcaacgaattgtgggtcttttgggctttgccg ctccttttacacaatgtggatacctgccttaatgcctttgtatgcatgtatacaagctaaacaggcttttactttctcgccaacttacaaggcctt ctaagtaaacagtatatgaacctttaccccgttgcccggcaacggcctggtctgtgccaagtgtttgctgatgcaacccccactggctgggc ttggccattggccatcagcgcatgcgcggaacctttgcggctcctctgccgatccatactgcggaactcctagcagcttgttttgctcgcagc aggtctggagcaaaactcatcgggactgataattctgtcgtcctttctcggaaatatacatcttttccatggctgctaggttgtactgccaactgg attcttcgcgggacgtccttgtttacgtcccgtcggcgctgaatcccgcggacgaccctctcggggtcgcttgggactctatcgtccccttc tccgtctgccgttccagccgaccacggggcgcacctctctttacgcggtctcccgtctgtgccttctcatctgccggaccgtgtgcacttcg
```

-continued

```
cttcacctctgcacgttgcatggagaccaccgtgaacgcccatcagagcctgcccaaggtcttacataagaggactcttggactctcatcaat gtcaacgaccgaccttgaagcttacttcaaagactgtgtgtttaaagactgggaagagtcggggaggaaattaggttaaaggtttatttatta ggaggctgtaggcataaattggtctgcgcaccagcaccatgcaacttttcacctctgcctaatcatctcttgtacatgtcccactgttcaagcct ccaagctgtgccttgggtggctttggggcatggacattgaccctataaagaatttggagctactgtggagttactctcattttttgccttctgactt ctttccttccgtccgggatctccttgataccgcctcagctctgtatcgggaagccttagagtctcctgagcattgctcacctcaccatacagcac tcaggcaagccattctctgctggggggaattaatgactctagctacctgggtgggtaataatttgcaagatccagcatccagggatctagtag tcaattatgttaatactaacatgggcctaaagatcaggcaactattgtggtttcatatttcttgtcttacttttggaagagatactgtgcttgagtattt ggtttctttcggagtgtggattcgcactcctcctgcctatagaccaccaaatgccctatcttatcaacacttccggaaactactgttgttagacg aagggaccgaggtaggtcccctagaagaagaactccctcgcctcgcagacgaagatctcaatcgccgcgtcgcag
```

Cells were plated in all wells of tissue-culture treated, 96-well plates at a final count of 10000 cells/well in 100 μL of the appropriate culture media. The cells were cultured for overnight after plating at 37° C. in the presence of 5% $CO_2$.

On the next day, complexes containing siNA, pSiCheck-HepB-Partial plasmid, and Lipofectamine (Invitrogen) were created as follows. A solution of siNA and plasmid was generated containing 500 nM siNA and 30 ng/ul plasmid. In parallel, a solution of Lipofectamine diluted 33-fold in OPTI-MEM was prepared. After incubation of RNAiMax/OPTI-MEM solution at room temperature for 5 min, an equal volume of the siNA solution and the RNAiMax solution were added together for each of the siNAs.

Mixing resulted in a solution of siNA/RNAiMax where the concentration of siNA was 60 nM and the plasmid was 3.6 ng/μl. This solution was incubated at room temperature for 20 minutes. After incubation, 20 μL of the solution was added to each of the relevant wells. The final concentration of siNA in each well was 10 nM and 0.6 ng/μl for the plasmid. The final volume of Lipofectamine in each well was 0.3 ul.

For 12-point dose response curve studies, the siNA series are 6-fold serial dilution starting at 30 nM or 4-fold serial dilution starting at 40 nM. All transfections were set up as multiple biological replicates.

The time of incubation with the Lipofectamine-siNA complexes was 48 hours and there was no change in media between transfection and harvesting for screening and dose response curve studies.

Luciferase Assays

50 μl of the Dual-Glo™ Firefly reagent (Promega, Madison, Wis.) was added to each well of the 96 well-plate and then the plate was incubated at room temperature for 10 minutes. The firefly luminescence was then read on a Wallac Envison plate reader using the Luciferase protocol. 50 μl of a 1:100 dilution of the Stop & Glo substrate (Promega, Madison, Wis.) was added to each well of the 96 well-plate and then the plate was incubated at room temperature for 10 minutes. The Renilla luminescence was then read on a Wallac Envison plate reader using the Luciferase protocol.

Calculations

The expression level of the gene of interest and % inhibition of gene expression (% KD) was calculated using a Comparative method:

$L\_firefly = \log 2(\text{firefly luc luminosity})$ $L\_renilla = \log 2(\text{renilla luc luminosity})$ $dL = L\_firefly + L\_renilla$ $ddL(\log 2(\text{foldchange})) = dL\_siRNA - dL\_NTC$ Relative expression level $= 2^{-ddL}$ $\% KD = 100 \times (1 - 2^{-ddL})$ The non-targeting control siNA was, unless otherwise indicated, chosen as the value against which to calculate the percent inhibition (knockdown) of gene expression, because it is the most relevant control.

Additionally, only normalized data, which reflects the general health of the cell and quality of the plasmid and siNAs, was examined. This was done by looking at the level of two different mRNAs in the treated cells, the first being the target mRNA and the second being the normalizer mRNA. This is done by comparing the log 2 luminescence for renilla luciferase (target) in each well relative to the log 2 luminescence for firefly luciferase (normalizer) for the entire plate. This allowed for elimination of siNAs that might be potentially toxic to cells rather than solely knocking down the gene of interest.

All calculations of $IC_{50}$s were performed using R.2.9.2 software. The data were analyzed using the sigmoidal dose-response (variable slope) equation for simple ligand binding. In all of the calculations of the percent inhibition (knockdown), the calculation was made relative to the normalized level of expression of the gene of interest in the samples treated with the non-targeting control (Ctrl siNA) unless otherwise indicated.

Results:

The HBV siNAs were designed and synthesized as described previously. Various siNAs were screened in HepG2 or Hepa1-6 cells transfected with the pSiCheck-HepB-Partial plasmid. The log 2(fold change) in HBV mRNA expression levels upon treatment with various modified HBV siNAs in human cells is shown in Table 3a and b. Each screen was performed at 48 hrs using the luicferase assay method.

TABLE 3a

Primary screening data in HepG2 Cells transfected with pSiCheck-HepB-partial (n = 2), recorded as log 2(fold change) in HBV mRNA expression levels

| siNA Duplex ID | Mean log 2 (fold change) | SD log 2 (fold change) |
|---|---|---|
| R-008351268-000C | 6.91 | 0.06 |
| R-008351278-000V | 5.40 | 0.02 |
| R-008351342-000A | 5.18 | 0.16 |
| R-008351172-000H | 5.43 | 0.09 |
| R-008351362-000K | 4.33 | 0.09 |
| R-008351389-000F | 4.82 | 0.21 |
| R-008351306-000R | 5.12 | 0.08 |
| R-008351372-000C | 4.33 | 0.22 |

TABLE 3a-continued

Primary screening data in HepG2 Cells transfected with pSiCheck-HepB-partial (n = 2), recorded as log 2(fold change) in HBV mRNA expression levels

| siNA Duplex ID | Mean log 2 (fold change) | SD log 2 (fold change) |
|---|---|---|
| R-008351317-000S | 5.07 | 0.06 |
| R-008351210-000W | 4.79 | 0.08 |
| R-008351329-000B | 4.71 | 0.20 |
| R-008351350-000A | 4.87 | 0.20 |
| R-008351303-000P | 4.97 | 0.06 |
| R-008351229-000S | 4.99 | 0.06 |
| R-008351386-000E | 5.08 | 0.08 |
| R-008351300-000N | 4.61 | 0.24 |
| R-008351263-000J | 4.49 | 0.02 |
| R-008351190-000A | 4.62 | 0.04 |
| R-008351326-000A | 4.67 | 0.09 |
| R-008351260-000H | 4.44 | 0.16 |
| R-008351195-000U | 4.37 | 0.08 |
| R-008351323-000Z | 4.42 | 0.21 |
| R-008351367-000D | 4.11 | 0.06 |
| R-008351251-002Z | 4.78 | 0.14 |
| R-008351240-000Y | 4.51 | 0.28 |
| R-008351178-000K | 4.26 | 0.17 |
| R-008351353-000B | 4.43 | 0.00 |
| R-008351297-000W | 4.13 | 0.12 |
| R-008351175-000J | 1.36 | 0.20 |
| R-008351181-000S | 2.68 | 0.12 |
| R-008351184-000T | 2.45 | 0.02 |
| R-008351187-000U | 0.51 | 0.13 |
| R-008351192-000T | 0.39 | 0.05 |
| R-008351198-000V | 0.52 | 0.22 |
| R-008351201-000M | 2.18 | 0.27 |
| R-008351204-000N | 0.48 | 0.25 |
| R-008351207-000P | 0.90 | 0.02 |
| R-008351212-000N | 0.45 | 0.26 |
| R-008351215-000P | 2.94 | 0.12 |
| R-008351218-000R | 1.24 | 0.02 |
| R-008351220-000N | 0.33 | 0.09 |
| R-008351223-000P | 0.64 | 0.17 |
| R-008351226-000R | 0.22 | 0.16 |
| R-008351232-000Y | 2.98 | 0.32 |
| R-008351235-002Z | 0.85 | 0.01 |
| R-008351237-000S | 3.12 | 0.11 |
| R-008351243-002Z | 3.79 | 0.09 |
| R-008351246-000A | 0.35 | 0.20 |
| R-008351248-000T | 0.52 | 0.29 |
| R-008351254-000A | 3.87 | 0.30 |
| R-008351257-000B | 3.13 | 0.05 |
| R-008351266-000K | 3.84 | 0.13 |
| R-008351271-000J | 3.04 | 0.18 |
| R-008351274-000K | 0.33 | 0.24 |
| R-008351276-000C | 2.09 | 0.15 |
| R-008351281-000B | 3.71 | 0.20 |
| R-008351284-000C | 3.96 | 0.16 |
| R-008351287-000D | 2.63 | 0.06 |
| R-008351290-000K | 0.47 | 0.27 |
| R-008351292-000C | 4.11 | 0.17 |
| R-008351294-000V | 4.13 | 0.16 |
| R-008351309-000S | 1.91 | 0.16 |
| R-008351312-000Y | 1.32 | 0.05 |
| R-008351315-002Z | 2.25 | 0.05 |
| R-008351320-000Y | 0.48 | 0.22 |
| R-008351332-000H | 3.23 | 0.01 |
| R-008351334-000A | 2.09 | 0.60 |
| R-008351337-000B | 3.65 | 0.15 |
| R-008351339-000U | 0.11 | 0.27 |
| R-008351345-000B | 2.93 | 0.01 |
| R-008351348-000C | 0.95 | 0.24 |
| R-008351356-000C | 1.54 | 0.49 |
| R-008351359-000D | 0.88 | 0.15 |
| R-008351364-000C | 4.01 | 0.10 |
| R-008351370-000K | 4.17 | 0.04 |
| R-008351374-000V | 1.59 | 0.16 |
| R-008351377-000W | 1.37 | 0.22 |
| R-008351380-000C | 1.80 | 0.08 |
| R-008351383-000D | 0.79 | 0.13 |
| R-008351392-000M | 3.91 | 0.01 |
| R-008351395-000N | 4.03 | 0.05 |
| R-008351398-000P | 0.69 | 0.12 |
| R-008351401-000G | 1.03 | 0.19 |
| R-008351404-000H | 2.57 | 0.10 |

TABLE 3b

Primary screening data in HepG2 Cells transfected with pSiCheck-HepB-partial (n = 2), recorded as log 2(fold change) in HBV mRNA expression levels

| siNA Duplex ID | Mean log 2 (fold change) | SD log 2 (fold change) |
|---|---|---|
| R-008351268-000C | 6.41 | 0.01 |
| R-008351278-000V | 5.26 | 0.05 |
| R-008351342-000A | 5.01 | 0.13 |
| R-008351172-000H | 5.29 | 0.01 |
| R-008351362-000K | 4.50 | 0.20 |
| R-008351389-000F | 4.99 | 0.05 |
| R-008351306-000R | 4.81 | 0.10 |
| R-008351372-000C | 4.85 | 0.01 |
| R-008351317-000S | 5.45 | 0.04 |
| R-008351210-000W | 4.71 | 0.17 |
| R-008351329-000B | 4.69 | 0.16 |
| R-008351350-000A | 4.79 | 0.00 |
| R-008351303-000P | 4.57 | 0.04 |
| R-008351229-000S | 4.87 | 0.23 |
| R-008351386-000E | 4.98 | 0.28 |
| R-008351300-000N | 4.48 | 0.06 |
| R-008351263-000J | 4.96 | 0.08 |
| R-008351190-000A | 4.61 | 0.04 |
| R-008351326-000A | 4.80 | 0.07 |
| R-008351260-000H | 4.16 | 0.18 |
| R-008351195-000U | 4.35 | 0.00 |
| R-008351323-000Z | 4.07 | 0.06 |
| R-008351367-000D | 4.28 | 0.08 |
| R-008351251-002Z | 4.96 | 0.91 |
| R-008351240-000Y | 4.63 | 0.01 |
| R-008351178-000K | 4.07 | 0.12 |
| R-008351353-000B | 4.20 | 0.02 |
| R-008351297-000W | 4.10 | 0.21 |
| R-008351175-000J | 1.26 | 0.28 |
| R-008351181-000S | 2.56 | 0.03 |
| R-008351184-000T | 2.57 | 0.25 |
| R-008351187-000U | 0.52 | 0.01 |
| R-008351192-000T | 0.01 | 0.25 |
| R-008351198-000V | 0.49 | 0.18 |
| R-008351201-000M | 2.26 | 0.11 |
| R-008351204-000N | 0.74 | 0.19 |
| R-008351207-000P | 0.58 | 0.34 |
| R-008351212-000N | 0.18 | 0.26 |
| R-008351215-000P | 3.17 | 0.14 |
| R-008351218-000R | 1.32 | 0.04 |
| R-008351220-000N | 0.15 | 0.05 |
| R-008351223-000P | 0.42 | 0.05 |
| R-008351226-000R | 0.49 | 0.07 |
| R-008351232-000Y | 3.06 | 0.27 |
| R-008351235-002Z | 0.93 | 0.09 |
| R-008351237-000S | 2.68 | 0.01 |
| R-008351243-002Z | 3.85 | 0.10 |
| R-008351246-000A | 0.34 | 0.01 |
| R-008351248-000T | 0.93 | 0.37 |
| R-008351254-000A | 4.15 | 0.17 |
| R-008351257-000B | 3.61 | 0.00 |
| R-008351266-000K | 3.87 | 0.25 |
| R-008351271-000J | 2.67 | 0.26 |
| R-008351274-000K | 0.43 | 0.16 |
| R-008351276-000C | 1.85 | 0.15 |
| R-008351281-000B | 3.76 | 0.97 |
| R-008351284-000C | 4.29 | 0.00 |

TABLE 3b-continued

Primary screening data in HepG2 Cells transfected with pSiCheck-HepB-partial (n = 2), recorded as log 2(fold change) in HBV mRNA expression levels

| siNA Duplex ID | Mean log 2 (fold change) | SD log 2 (fold change) |
| --- | --- | --- |
| R-008351287-000D | 2.06 | 0.09 |
| R-008351290-000K | 0.11 | 0.14 |
| R-008351292-000C | 3.99 | 0.01 |
| R-008351294-000V | 4.07 | 0.18 |
| R-008351309-000S | 1.99 | 0.21 |
| R-008351312-000Y | 1.11 | 0.09 |
| R-008351315-000Z | 2.15 | 0.06 |
| R-008351320-000Y | 0.35 | 0.19 |
| R-008351332-000H | 2.86 | 0.04 |
| R-008351334-000A | 1.71 | 0.01 |
| R-008351337-000B | 3.59 | 0.01 |
| R-008351339-000U | 0.21 | 0.18 |
| R-008351345-000B | 3.09 | 0.23 |
| R-008351348-000C | 0.92 | 0.12 |
| R-008351356-000C | 1.60 | 0.09 |
| R-008351359-000D | 0.76 | 0.01 |
| R-008351364-000C | 4.37 | 0.05 |
| R-008351370-000K | 3.99 | 0.19 |
| R-008351374-000V | 1.06 | 0.10 |
| R-008351377-000W | 1.20 | 0.09 |
| R-008351380-000C | 1.33 | 0.25 |
| R-008351383-000D | 0.24 | 0.19 |
| R-008351392-000M | 3.83 | 0.08 |
| R-008351395-000N | 3.58 | 0.01 |
| R-008351398-000P | 0.53 | 0.01 |
| R-008351401-000G | 1.04 | 0.09 |
| R-008351404-000H | 2.82 | 0.04 |

A subset of siNAs from Table 3a and Table 3b having a large log 2(fold change) in the primary screen were re-racked onto a single 96-well plate in triplicate and screened again in human HepG2 cells transfected with pSiCheck_HepB-partial in order to confirm knockdown and to directly compare siNAs that were synthesized on different plates. Table 4 summarizes the data. The siNAs were ranked based on log 2(fold change) in HBV mRNA expression levels.

TABLE 4

Log2(fold change) of various siNAs tested on a re-racked plate

| siNA Duplex ID | Mean log 2 (fold change) | SD log 2 (fold change) |
| --- | --- | --- |
| R-008351268-000C | 6.38 | 0.17 |
| R-008351278-000V | 5.71 | 0.23 |
| R-008351342-000A | 5.21 | 0.22 |
| R-008351172-000H | 5.00 | 0.11 |
| R-008351362-000K | 4.58 | 0.20 |
| R-008351389-000F | 4.84 | 0.44 |
| R-008351306-000R | 5.13 | 0.18 |
| R-008351372-000C | 4.77 | 0.09 |
| R-008351317-000S | 5.19 | 0.13 |
| R-008351210-000W | 4.68 | 0.09 |
| R-008351329-000B | 4.71 | 0.08 |
| R-008351350-000A | 4.54 | 0.16 |
| R-008351303-000P | 4.94 | 0.05 |
| R-008351229-000S | 4.85 | 0.13 |
| R-008351386-000E | 5.03 | 0.11 |
| R-008351300-000N | 4.51 | 0.20 |
| R-008351263-000J | 4.74 | 0.28 |
| R-008351190-000A | 4.50 | 0.15 |
| R-008351326-000A | 4.47 | 0.05 |
| R-008351260-000H | 4.33 | 0.27 |
| R-008351195-000U | 4.30 | 0.03 |
| R-008351323-000Z | 4.30 | 0.08 |
| R-008351367-000D | 4.23 | 0.06 |
| R-008351251-000Z | 4.21 | 0.09 |
| R-008351240-000Y | 4.14 | 0.22 |

TABLE 4-continued

Log2(fold change) of various siNAs tested on a re-racked plate

| siNA Duplex ID | Mean log 2 (fold change) | SD log 2 (fold change) |
| --- | --- | --- |
| R-008351178-000K | 4.11 | 0.08 |
| R-008351353-000B | 3.86 | 0.06 |
| R-008351297-000W | 3.79 | 0.20 |

Select high ranking (larger log 2(fold change) value) siNAs from Table 4 were further analyzed for efficacy and potency in HepG2cells transfected with pSiCheck-HepB-partial Plasmid. Cells were treated with a 1:6 serial dose titration of siNA in order to establish a value. The Potency50 is the calculated siNA transfection concentration that produces 50% target mRNA knockdown. The results for these siNAs are shown in Table 5.

TABLE 5

Dose response data for various siNAs in HepG2 -Human hepatoma cell line transfected with pSiCheck-HepB-partial. Calculated maximum log 2(fold change) is determined from the dose response curve.

| siNA Duplex ID | ssDRC max log 2 (fold change) | Potency50 (nM) |
| --- | --- | --- |
| R-008351268-000C | 7.00 | 0.02 |
| R-008351278-000V | 5.59 | 0.11 |
| R-008351342-000A | 5.59 | 0.05 |
| R-008351172-000H | 5.52 | 0.07 |
| R-008351362-000K | 5.52 | 0.15 |
| R-008351389-000F | 5.33 | 0.16 |
| R-008351306-000R | 5.25 | 0.19 |
| R-008351372-000C | 5.21 | 0.09 |
| R-008351317-000S | 5.12 | 0.11 |
| R-008351210-000W | 4.93 | 0.17 |
| R-008351329-000B | 4.92 | 0.05 |
| R-008351350-000A | 4.92 | 0.18 |
| R-008351303-000P | 4.81 | 0.15 |
| R-008351229-000S | 4.81 | 0.03 |
| R-008351386-000E | 4.71 | 0.34 |
| R-008351300-000N | 4.63 | 0.15 |
| R-008351263-000J | 4.46 | 0.16 |
| R-008351190-000A | 4.45 | 0.10 |

Select top performing sequences identified in the previous screens, based on high ranking (larger log 2(fold change) value and low Potency$_{50}$ values from Table 5 were then syntheisezd in various chemical modifications on both passenger and guide strand. These siNAs were then analyzed for efficacy and potency in Hepa1-6 cells transfected with pSiCheck-HepB-partial Plasmid. The log 2(fold change) in HBV mRNA expression levels upon treatment with various modified HBV siNAs in human cells is shown in Table 6A. Each screen was performed at 48 hrs using the luicferase assay method.

TABLE 6A

Primary screening data of Lead Optimized HBV Sequences in Hepa1-6 Cells transfected with pSiCheck-HepB-partial (n = 2), recorded as log 2(fold change) in HBV mRNA expression levels

| siNA Duplex ID | Mean log 2 (fold change) | SD log 2 (fold change) |
| --- | --- | --- |
| R-008380633-000U | 6.29 | 0.03 |
| R-008380783-000R | 6.23 | 0.11 |
| R-008380330-000N | 6.19 | 0.06 |
| R-008380665-000N | 6.18 | 0.15 |
| R-008380648-000E | 6.15 | 0.20 |

TABLE 6A-continued

Primary screening data of Lead Optimized HBV Sequences in Hepa1-6 Cells transfected with pSiCheck-HepB-partial (n = 2), recorded as log 2(fold change) in HBV mRNA expression levels

| siNA Duplex ID | Mean log 2 (fold change) | SD log 2 (fold change) |
|---|---|---|
| R-008380558-000M | 6.08 | 0.10 |
| R-008380365-000J | 5.96 | 0.20 |
| R-008380406-000Y | 5.96 | 0.10 |
| R-008380764-000P | 5.95 | 0.02 |
| R-008380394-000C | 5.94 | 0.21 |
| R-008380740-000V | 5.93 | 0.03 |
| R-008380408-000R | 5.90 | 0.11 |
| R-008380576-000E | 5.87 | 0.02 |
| R-008380645-000D | 5.86 | 0.03 |
| R-008380777-000H | 5.85 | 0.18 |
| R-008380730-000C | 5.82 | 0.10 |
| R-008380363-000S | 5.81 | 0.07 |
| R-008380767-000R | 5.79 | 0.23 |
| R-008380359-000B | 5.79 | 0.09 |
| R-008380763-000F | 5.76 | 0.04 |
| R-008380362-000H | 5.75 | 0.19 |
| R-008380771-000F | 5.72 | 0.09 |
| R-008380340-000F | 5.72 | 0.05 |
| R-008380417-000Z | 5.66 | 0.09 |
| R-008380377-000U | 5.65 | 0.07 |
| R-008380389-000D | 5.63 | 0.19 |
| R-008380772-000P | 5.58 | 0.03 |
| R-008380785-000H | 5.56 | 0.03 |
| R-008380680-000E | 5.47 | 0.02 |
| R-008380453-000J | 5.46 | 0.02 |
| R-008380750-000M | 5.42 | 0.02 |
| R-008380776-000Z | 5.41 | 0.30 |
| R-008380391-000B | 5.40 | 0.07 |
| R-008380793-000H | 5.35 | 0.09 |
| R-008380402-000N | 5.33 | 0.26 |
| R-008380516-000A | 5.27 | 0.03 |
| R-008380492-000V | 5.22 | 0.25 |
| R-008380718-000M | 5.21 | 0.02 |
| R-008380603-000S | 5.20 | 0.04 |
| R-008380729-000N | 5.19 | 0.02 |
| R-008380795-000A | 5.14 | 0.09 |
| R-008380429-000J | 5.13 | 0.07 |
| R-008380760-000E | 5.12 | 0.04 |
| R-008380459-000L | 5.12 | 0.11 |
| R-008380733-000D | 5.06 | 0.22 |
| R-008380683-000F | 5.04 | 0.04 |
| R-008380564-000V | 5.02 | 0.01 |
| R-008380582-000M | 5.01 | 0.15 |
| R-008380418-000H | 4.98 | 0.04 |
| R-008380540-000A | 4.93 | 0.07 |
| R-008380651-000L | 4.91 | 0.12 |
| R-008380774-000G | 4.89 | 0.01 |
| R-008380489-000N | 4.86 | 0.14 |
| R-008380656-000E | 4.86 | 0.11 |
| R-008380739-000F | 4.79 | 0.01 |
| R-008380462-000T | 4.73 | 0.08 |
| R-008380324-000F | 4.72 | 0.06 |
| R-008380773-000Y | 4.69 | 0.17 |
| R-008380361-000Z | 4.69 | 0.35 |
| R-008380798-000B | 4.69 | 0.10 |
| R-008380432-000R | 4.66 | 0.16 |
| R-008380796-000J | 4.63 | 0.03 |
| R-008380794-000S | 4.63 | 0.03 |
| R-008380420-000F | 4.61 | 0.11 |
| R-008380543-000B | 4.59 | 0.16 |
| R-008380642-000C | 4.57 | 0.04 |
| R-008380731-000L | 4.55 | 0.11 |
| R-008380346-000H | 4.50 | 0.02 |
| R-008380378-000C | 4.47 | 0.29 |
| R-008380477-000D | 4.46 | 0.01 |
| R-008380405-000P | 4.43 | 0.16 |
| R-008380749-000Y | 4.42 | 0.27 |
| R-008380537-000U | 4.41 | 0.12 |
| R-008380436-000A | 4.40 | 0.19 |
| R-008380742-000M | 4.34 | 0.13 |
| R-008380765-000Y | 4.31 | 0.09 |
| R-008380353-000Z | 4.29 | 0.10 |
| R-008380712-000K | 4.22 | 0.02 |
| R-008380784-000Z | 4.20 | 0.07 |
| R-008380379-000L | 4.20 | 0.24 |
| R-008380753-000N | 4.19 | 0.09 |
| R-008380689-000H | 4.15 | 0.06 |
| R-008380654-000M | 4.15 | 0.14 |
| R-008380374-000T | 4.13 | 0.32 |
| R-008380782-000G | 4.08 | 0.07 |
| R-008380480-000K | 4.06 | 0.15 |
| R-008380766-000G | 4.02 | 0.26 |
| R-008380348-000A | 4.01 | 0.21 |
| R-008380734-000M | 3.97 | 0.09 |
| R-008380486-000M | 3.97 | 0.09 |
| R-008380579-000F | 3.97 | 0.11 |
| R-008380437-000J | 3.93 | 0.14 |
| R-008380781-000Y | 3.91 | 0.10 |
| R-008380416-000R | 3.88 | 0.29 |
| R-008380343-000G | 3.88 | 0.19 |
| R-008380704-000K | 3.88 | 0.29 |
| R-008380797-000T | 3.85 | 0.13 |
| R-008380736-000E | 3.84 | 0.02 |
| R-008380706-000C | 3.83 | 0.20 |
| R-008380751-000W | 3.83 | 0.17 |
| R-008380756-000P | 3.83 | 0.21 |
| R-008380732-000V | 3.79 | 0.20 |
| R-008380321-000E | 3.75 | 0.05 |
| R-008380755-000F | 3.71 | 0.27 |
| R-008380528-000K | 3.67 | 0.08 |
| R-008380531-000S | 3.64 | 0.20 |
| R-008380426-000H | 3.60 | 0.02 |
| R-008380311-000M | 3.58 | 0.18 |
| R-008380737-000N | 3.54 | 0.20 |
| R-008380757-000Y | 3.52 | 0.07 |
| R-008380787-000A | 3.46 | 0.08 |
| R-008380726-000M | 3.46 | 0.35 |
| R-008380678-000G | 3.44 | 0.18 |
| R-008380597-000Y | 3.40 | 0.09 |
| R-008380686-000G | 3.37 | 0.11 |
| R-008380636-000V | 3.31 | 0.05 |
| R-008380791-000N | 3.27 | 0.24 |
| R-008380567-000W | 3.27 | 0.08 |
| R-008380624-000K | 3.21 | 0.02 |
| R-008380775-000R | 3.21 | 0.04 |
| R-008380315-000X | 3.19 | 0.04 |
| R-008380407-000G | 3.13 | 0.21 |
| R-008380741-000D | 3.10 | 0.20 |
| R-008380352-000R | 3.09 | 0.07 |
| R-008380450-000H | 3.08 | 0.09 |
| R-008380549-000D | 3.05 | 0.08 |
| R-008380789-000T | 3.04 | 0.11 |
| R-008380746-000X | 3.03 | 0.10 |
| R-008380510-000Y | 3.00 | 0.04 |
| R-008380703-000B | 3.00 | 0.02 |
| R-008380664-000E | 2.98 | 0.15 |
| R-008380754-000X | 2.98 | 0.06 |
| R-008380759-000R | 2.96 | 0.14 |
| R-008380399-000W | 2.94 | 0.13 |
| R-008380735-000W | 2.92 | 0.13 |
| R-008380609-000U | 2.86 | 0.16 |
| R-008380386-000C | 2.85 | 0.16 |
| R-008380778-000S | 2.82 | 0.11 |
| R-008380428-000A | 2.78 | 0.31 |
| R-008380483-000L | 2.75 | 0.07 |
| R-008380444-000A | 2.73 | 0.13 |
| R-008380716-000V | 2.69 | 0.16 |
| R-008380356-000A | 2.69 | 0.06 |
| R-008380667-000F | 2.69 | 0.23 |
| R-008380671-000W | 2.68 | 0.10 |
| R-008380705-000U | 2.67 | 0.16 |
| R-008380410-000N | 2.65 | 0.16 |
| R-008380431-000G | 2.61 | 0.07 |
| R-008380738-000X | 2.60 | 0.06 |
| R-008380427-000S | 2.54 | 0.13 |
| R-008380313-000E | 2.49 | 0.30 |

TABLE 6A-continued

Primary screening data of Lead Optimized HBV Sequences in Hepa1-6 Cells transfected with pSiCheck-HepB-partial (n = 2), recorded as log 2(fold change) in HBV mRNA expression levels

| siNA Duplex ID | Mean log 2 (fold change) | SD log 2 (fold change) |
| --- | --- | --- |
| R-008380728-000E | 2.43 | 0.05 |
| R-008380792-000Z | 2.40 | 0.02 |
| R-008380588-000P | 2.40 | 0.17 |
| R-008380397-000D | 2.39 | 0.01 |
| R-008380423-000G | 2.37 | 0.07 |
| R-008380434-000H | 2.37 | 0.14 |
| R-008380316-000F | 2.27 | 0.21 |
| R-008380555-000L | 2.25 | 0.00 |
| R-008380790-000G | 2.23 | 0.09 |
| R-008380398-000M | 2.21 | 0.07 |
| R-008380699-000A | 2.16 | 0.25 |
| R-008380719-000W | 2.15 | 0.22 |
| R-008380335-000G | 2.14 | 0.45 |
| R-008380618-000C | 2.06 | 0.11 |
| R-008380672-000E | 2.02 | 0.02 |
| R-008380534-000T | 2.02 | 0.00 |
| R-008380381-000J | 2.00 | 0.22 |
| R-008380674-000X | 1.97 | 0.02 |
| R-008380725-000D | 1.97 | 0.10 |
| R-008380770-000X | 1.97 | 0.11 |
| R-008380369-000U | 1.86 | 0.17 |
| R-008380662-000M | 1.86 | 0.07 |
| R-008380333-000P | 1.78 | 0.21 |
| R-008380413-000P | 1.73 | 0.23 |
| R-008380748-000P | 1.73 | 0.16 |
| R-008380688-000Z | 1.71 | 0.10 |
| R-008380747-000F | 1.70 | 0.18 |
| R-008380337-000Z | 1.62 | 0.15 |
| R-008380711-000B | 1.62 | 0.07 |
| R-008380522-000H | 1.61 | 0.17 |
| R-008380308-000F | 1.56 | 0.08 |
| R-008380387-000L | 1.54 | 0.03 |
| R-008380720-000K | 1.50 | 0.07 |
| R-008380769-000H | 1.48 | 0.21 |
| R-008380404-000F | 1.46 | 0.04 |
| R-008380786-000S | 1.46 | 0.03 |
| R-008380630-000T | 1.44 | 0.05 |
| R-008380727-000W | 1.41 | 0.19 |
| R-008380779-000A | 1.38 | 0.04 |
| R-008380594-000X | 1.34 | 0.05 |
| R-008380438-000T | 1.32 | 0.06 |
| R-008380456-000K | 1.32 | 0.00 |
| R-008380768-000Z | 1.30 | 0.00 |
| R-008380600-000R | 1.28 | 0.00 |
| R-008380762-000X | 1.25 | 0.18 |
| R-008380370-000H | 1.19 | 0.17 |
| R-008380349-000J | 1.19 | 0.36 |
| R-008380390-000T | 1.19 | 0.31 |
| R-008380447-000B | 1.13 | 0.06 |
| R-008380666-000X | 1.12 | 0.25 |
| R-008380639-000W | 1.11 | 0.03 |
| R-008380546-000C | 1.05 | 0.07 |
| R-008380685-000Y | 1.04 | 0.02 |
| R-008380698-000S | 1.04 | 0.09 |
| R-008380414-000Y | 1.03 | 0.10 |
| R-008380401-000E | 1.02 | 0.24 |

TABLE 6B

Log2(fold change) of various siNAs tested on a re-racked plate

| siNA Duplex ID | Mean log 2 (fold change) | SD log 2 (fold change) |
| --- | --- | --- |
| R-008380665-000N | 6.79 | 0.09 |
| R-008380648-000E | 6.53 | 0.09 |
| R-008380633-000U | 6.45 | 0.05 |
| R-008380783-000R | 6.45 | 0.06 |
| R-008380408-000R | 6.36 | 0.05 |
| R-008380645-000D | 6.34 | 0.04 |
| R-008380767-000R | 6.32 | 0.01 |
| R-008380764-000P | 6.26 | 0.18 |
| R-008380406-000Y | 6.23 | 0.04 |
| R-008380740-000V | 6.21 | 0.14 |
| R-008380730-000C | 6.19 | 0.06 |
| R-008380362-000H | 6.17 | 0.06 |
| R-008380340-000F | 6.12 | 0.10 |
| R-008380558-000M | 6.11 | 0.09 |
| R-008380389-000D | 6.10 | 0.22 |
| R-008380363-000S | 6.09 | 0.06 |
| R-008380777-000H | 6.08 | 0.07 |
| R-008380772-000P | 6.02 | 0.03 |
| R-008380576-000E | 6.00 | 0.05 |
| R-008380771-000F | 5.99 | 0.03 |
| R-008380359-000B | 5.99 | 0.12 |
| R-008380377-000U | 5.97 | 0.06 |
| R-008380763-000F | 5.94 | 0.11 |
| R-008380680-000E | 5.90 | 0.01 |
| R-008380776-000Z | 5.86 | 0.04 |
| R-008380793-000H | 5.86 | 0.04 |
| R-008380417-000Z | 5.85 | 0.07 |
| R-008380785-000H | 5.83 | 0.04 |
| R-008380750-000M | 5.63 | 0.02 |
| R-008380420-000F | 5.10 | 0.09 |
| R-008380782-000G | 4.47 | 0.31 |
| R-008380753-000N | 4.45 | 0.15 |
| R-008380689-000H | 4.42 | 0.04 |
| R-008380755-000F | 4.36 | 0.13 |
| R-008380736-000E | 4.35 | 0.05 |
| R-008380346-000H | 4.35 | 0.02 |
| R-008380756-000P | 4.32 | 0.01 |
| R-008380734-000M | 4.21 | 0.09 |
| R-008380781-000Y | 4.17 | 0.03 |
| R-008380737-000N | 4.03 | 0.26 |
| R-008380757-000Y | 3.97 | 0.06 |
| R-008380791-000R | 3.89 | 0.03 |
| R-008380528-000K | 3.78 | 0.06 |
| R-008380787-000A | 3.65 | 0.13 |
| R-008380686-000G | 3.63 | 0.16 |
| R-008380754-000X | 3.54 | 0.08 |
| R-008380597-000Y | 3.49 | 0.07 |
| R-008380321-000E | 3.47 | 0.09 |
| R-008380567-000W | 3.43 | 0.05 |
| R-008380624-000K | 3.27 | 0.08 |
| R-008380789-000T | 3.20 | 0.09 |
| R-008380746-000X | 3.18 | 0.03 |
| R-008380778-000S | 3.13 | 0.10 |
| R-008380735-000W | 3.08 | 0.09 |
| R-008380399-000W | 2.82 | 0.02 |
| R-008380410-000N | 2.60 | 0.08 |
| R-008380311-000M | 1.24 | 0.07 |
| R-008380353-000Z | 1.11 | 0.03 |
| R-008380348-000A | 0.75 | 0.04 |
| R-008380315-000X | 0.69 | 0.06 |

A subset of siNAs from Table 6a having a large log 2(fold change) in the primary screen were re-racked onto a single 96-well plate in triplicate and screened again in murine Heap1-6 cells transfected with pSiCheck HepB-partial in order to confirm knockdown and to directly compare siNAs that were synthesized on different plates. Table 6B. summarizes the data. The siNAs were ranked based on log 2(fold change) in HBV mRNA expression levels.

Select high ranking (larger log 2(fold change) value) siNAs from Table 6b were further analyzed for efficacy and potency in Hepa1-6 cells transfected with pSiCheck-HepB-partial Plasmid. Cells were treated with a 1:6 serial dose titration of siNA in order to establish a value. The Potency50 is the calculated siNA transfection concentration that produces 50% target mRNA knockdown. The results for these siNAs are shown in Table 6c.

TABLE 6c

Dose response data for various siNAs in Hepa1-6 murine hepatoma cell line transfected with pSiCheck-HepB-partial. Calculated maximum log 2(fold change) is determined from the dose response curve.

| siNA Duplex ID | ssDRC max log 2 (fold change) | Potency50 (nM) |
| --- | --- | --- |
| R-008380648-000E | 7.78 | 0.104 |
| R-008380783-000R | 7.01 | 0.023 |
| R-008380665-000N | 6.97 | 0.008 |
| R-008380645-000D | 6.92 | 0.032 |
| R-008380408-000R | 6.80 | 0.016 |
| R-008380633-000U | 6.79 | 0.012 |
| R-008380767-000R | 6.72 | 0.028 |
| R-008380730-000C | 6.58 | 0.038 |
| R-008380777-000H | 6.57 | 0.020 |
| R-008380740-000V | 6.55 | 0.019 |
| R-008380558-000M | 6.45 | 0.014 |
| R-008380406-000Y | 6.32 | 0.006 |
| R-008380764-000P | 6.27 | 0.030 |
| R-008380772-000P | 6.26 | 0.024 |
| R-008380389-000D | 6.22 | 0.021 |
| R-008380362-000H | 6.17 | 0.014 |
| R-008380363-000S | 5.87 | 0.009 |
| R-008380340-000F | 5.76 | 0.016 |
| R-008380689-000H | 5.30 | 0.036 |
| R-008380756-000P | 5.00 | 0.186 |
| R-008380736-000E | 4.96 | 0.076 |
| R-008380757-000Y | 4.88 | 0.216 |
| R-008380753-000N | 4.87 | 0.184 |
| R-008380737-000N | 4.69 | 0.142 |
| R-008380734-000M | 4.65 | 0.226 |
| R-008380791-000R | 4.37 | 0.101 |

Example 2

Determining In Vitro Serum Stability of siNAs siNAs are reconstituted as 50 µM to 100 µM stock solution with H$_2$O and added to human serum pre-warmed to 37° C. to a final concentration of 20 m/mL. The mixture is then incubated at 37° C. for 0, 1 and 2 hours. At the end of each time point, the reactions are stopped by mixing with equal volume of Phenomenex Lysis-Loading Buffer. Oligonucleotides are purified in 96-well format by Phenomenex Solid Phase Extraction and lyophilized until dry with Labconco Triad Lyo-00417. The lyophilized samples are reconstituted in 150 µL of 1 mM EDTA prepared with RNase-free H$_2$O. The sample solutions re then diluted 5 fold with 1 mM EDTA for liquid chromatography/mass spectrometry (LC/MS) analysis on ThermoFisher Orbitrap. Serum metabolites of the siNAs were determined based on the measured molecular weights.

Example 3

Testing of Cytokine Induction

To assess immunostimulative effects of various siNAs of the invention loaded in lipid nanoparticles (e.g., DLinDMA/Cholesterol/S-PEG-C-DMA/DSPC in a 40/48/2/10 ratio), C57B1/6 mice are dosed with a single 3 mpk dose of LNP formulated siNAs through tail vein injection. Serum or plasma samples are collected at 3 and 24 hours post-dose. The cytokine and chemokine levels in these samples is measured with the SearchLight IR Cytokine Array from Aushon Biosciences according to the manufacturer's instruction. The cytokines and chemokines measured are IL-1α, IL-1β, IL-6, KC, IL-10, IFNγ, TNF, GMCSF, MIP-1β, MCP-1/JE, and RANTES.

Example 4

Efficacy Studies in Mouse

In vivo efficacy studies are conducted in SCID mice with humanized livers that are subsequently inject with HBV. Transgenic mice with diseased livers are injected with human primary hepatocytes that allows repopulation of the mouse liver with up to 70% human hepatocytes. Mice are then inoculated with human HBV isolates. Infected mice are dosed IV via tail vein injections with LNP encapsulated siNAs or vehicle control using a single 3 mpk dose. Effect of siNA on viral load is determined taking serum sample at various time points post-dosing and then measuring the level of circulating HBV genomes in the serum by qPCR.

Example 5

Pharmacodynamic Study in Non-Human Primates

HBV-infected chimpanzees are dosed with a single 2.5 mpk dose of siNA loaded lipid nanoparticles through intravenous infusion. To monitor HBV virus load, serum samples are taken at various time points pre- and post-dose and the level of HBV genomes are determined via qPCR. All procedures adhere to the regulations outlined in the USDA Animal Welfare Act (9 CFR, Parts 1, 2 and 3) and the conditions specified in The Guide for Care and Use of Laboratory Animals (ILAR publication, 1996, National Academy Press).

Example 6 siNAs LNP Formulations

A. General LNP Process Description for DLinDMA Formulations:

The lipid nanoparticles are prepared by an impinging jet process. The particles are formed by mixing lipids dissolved in alcohol with siNA dissolved in a citrate buffer. The mixing ratio of lipids to siNA is targeted at 45-55% lipid and 65-45% siNA. The lipid solution contains a cationic lipid, a helper lipid (cholesterol), PEG (e.g. PEG-C-DMA, PEG-DMG) lipid, and DSPC at a concentration of 5-15 mg/mL with a target of 9-12 mg/mL in an alcohol (for example ethanol). The ratio of the lipids has a mole percent range of 25-98 for the cationic lipid with a target of 35-65, the helper lipid has a mole percent range from 0-75 with a target of 30-50, the PEG lipid has a mole percent range from 1-15 with a target of 1-6, and the DSPC has a mole percent range of 0-15 with a target of 0-12. The siNA solution contains one or more siNA sequences at a concentration range from 0.3 to 1.0 mg/mL with a target of 0.3-0.9 mg/mL in a sodium citrate buffered salt solution with pH in the range of 3.5-5. The two liquids are heated to a temperature in the range of 15-40° C., targeting 30-40° C., and then mixed in an impinging jet mixer instantly forming the LNP. The teeID has a range from 0.25 to 1.0 mm and a total flow rate from 10-600 mL/minute The combination of flow rate and tubing ID has the effect of controlling the particle size of the LNPs between 30 and 200 nm. The solution is then mixed with a buffered solution at a higher pH with a mixing ratio in the range of 1:1 to 1:3 vol:vol but targeting 1:2 vol:vol. This buffered solution is at a temperature in the range of 15-40° C., targeting 30-40° C. The mixed LNPs are held from 30 minutes to 2 hrs prior to an anion exchange filtration step. The temperature during incubating is in the range of 15-40° C., targeting 30-40° C. After incubating, the solution are filtered through a 0.8 um filter containing an anion exchange separation step. This process uses tubing IDs ranging from 1 mm ID to 5 mm ID and a flow rate from 10 to 2000 mL/minute The LNPs are concentrated and diafiltered via an ultrafiltration process where the alcohol is removed and the citrate buffer is exchanged for the final buffer solution such as phosphate buffered saline. The ultrafiltration process uses a tangential flow filtration format (TFF). This process uses a membrane nominal molecular weight cutoff range from 30-500 KD. The membrane format is hollow fiber or flat sheet cassette. The TFF processes with the proper molecular weight cutoff retains the LNP in the retentate and the filtrate or permeate contains the alcohol; citrate buffer; and final buffer wastes. The TFF process is a multiple step process with an initial concentration to a siNA concentration of 1-3 mg/mL. Following concentration, the LNPs solution is diafiltered against the final buffer for 10-20 volumes to remove the alcohol and perform buffer exchange. The material is then concentrated an additional 1-3 fold. The final steps of the LNP process are to sterile filter the concentrated LNP solution and vial the product.

Analytical Procedure:

1) siNA Concentration

The siNA duplex concentrations are determined by Strong Anion-Exchange High-Performance Liquid Chromatography (SAX-HPLC) using Waters 2695 Alliance system (Water Corporation, Milford Mass.) with a 2996 PDA detector. The LNPs, otherwise referred to as RNAi Delivery Vehicles (RDVs), are treated with 0.5% Triton X-100 to free total siNA and analyzed by SAX separation using a Dionex BioLC DNAPac PA 200 (4×250 mm) column with UV detection at 254 nm. Mobile phase is composed of A: 25 mM NaClO$_4$, 10 mM Tris, 20% EtOH, pH 7.0 and B: 250 mM NaClO$_4$, 10 mM Tris, 20% EtOH, pH 7.0 with a liner gradient from 0-15 min and a flow rate of 1 ml/minute. The siNA amount is determined by comparing to the siNA standard curve.

2) Encapsulation Rate

Fluorescence reagent SYBR Gold is employed for RNA quantitation to monitor the encapsulation rate of RDVs. RDVs with or without Triton X-100 are used to determine the free siNA and total siNA amount. The assay is performed using a SpectraMax M5e microplate spectrophotometer from Molecular Devices (Sunnyvale, Calif.). Samples are excited at 485 nm and fluorescence emission is measured at 530 nm. The siNA amount is determined by comparing to an siNA standard curve.

Encapsulation rate=(1−free siNA/total siNA)×100%

3) Particle Size and Polydispersity

RDVs containing 1 µg siNA are diluted to a final volume of 3 ml with 1×PBS. The particle size and polydispersity of the samples is measured by a dynamic light scattering method using ZetaPALS instrument (Brookhaven Instruments Corporation, Holtsville, N.Y.). The scattered intensity is measured with He—Ne laser at 25° C. with a scattering angle of 90°.

4) Zeta Potential Analysis

RDVs containing 1 µg siNA are diluted to a final volume of 2 ml with 1 mM Tris buffer (pH 7.4). Electrophoretic mobility of samples is determined using ZetaPALS instrument (Brookhaven Instruments Corporation, Holtsville, N.Y.) with electrode and He—Ne laser as a light source. The Smoluchowski limit is assumed in the calculation of zeta potentials.

5) Lipid Analysis

Individual lipid concentrations are determined by Reverse Phase High-Performance Liquid Chromatography (RP-HPLC) using Waters 2695 Alliance system (Water Corporation, Milford Mass.) with a Corona charged aerosol detector (CAD) (ESA Biosciences, Inc, Chelmsford, Mass.). Individual lipids in RDVs are analyzed using an Agilent Zorbax SB-C18 (50×4.6 mm, 1.8 µm particle size) column with CAD at 60° C. The mobile phase is composed of A: 0.1% TFA in H$_2$O and B: 0.1% TFA in IPA. The gradient changes from 60% mobile phase A and 40% mobile phase B from time 0 to 40% mobile phase A and 60% mobile phase B at 1.00 min; 40% mobile phase A and 60% mobile phase B from 1.00 to 5.00 min; 40% mobile phase A and 60% mobile phase B from 5.00 min to 25% mobile phase A and 75% mobile phase B at 10.00 min; 25% mobile phase A and 75% mobile phase B from 10.00 min to 5% mobile phase A and 95% mobile phase B at 15.00 min; and 5% mobile phase A and 95% mobile phase B from 15.00 to 60% mobile phase A and 40% mobile phase B at 20.00 min with a flow rate of 1 ml/minute. The individual lipid concentration is determined by comparing to the standard curve with all the lipid components in the RDVs with a quadratic curve fit. The molar percentage of each lipid is calculated based on its molecular weight.

B. General Formulation Procedure for CLinDMA/Cholesterol/PEG-DMG at a ratio of 71.9:20.2:7.9.

siNA solutions were prepared by dissolving siNAs in 25 mM citrate buffer (pH 4.0) at a concentration of 0.8 mg/mL. Lipid solutions were prepared by dissolving a mixture of 2S-Octyl-ClinDMA, cholesterol and PEG-DMG at a ratio of 71.9:20.2:7.9 in absolute ethanol at a concentration of about 10 mg/mL. Equal volume of siNA and lipid solutions were delivered with two syringe pumps at the same flow rates to a mixing T connector. The resulting milky mixture was collected in a sterile bottle. This mixture was then diluted slowly with an equal volume of citrate buffer, and filtered through a size exclusion hollow fiber cartridge to remove any free siNA in the mixture. Ultra filtration against citrate buffer (pH 4.0) was employed to remove ethanol (test stick from ALCO screen), and against PBS (pH 7.4) to exchange buffer. The final LNP was obtained by concentrating to a desired volume and sterile filtered through a 0.2 mm filter. The obtained LNPs were characterized in term of particle size, alcohol content, total lipid content, nucleic acid encapsulated, and total nucleic acid concentration.

C. General LNP Preparation for Various Formulations in Table 10 siNA nanoparticle suspensions in Table 10 were prepared by dissolving siNAs and/or carrier molecules in 20 mM sodium citrate buffer (pH 5.0) at a concentration of about 0.40 mg/mL. Lipid solutions were prepared by dissolving a mixture of cationic lipid (e.g., (13Z,16Z)—N,N-dimethyl-3-nonyldocosa-13,16-dien-1-amine, see structure in Table 11), DSPC, Cholesterol, and PEG-DMG (ratios shown in Table 10) in absolute ethanol at a concentration of about 8 mg/mL. The nitrogen to phosphate ratio was approximated to 6:1.

Nearly equal volumes of siNA/carrier and lipid solutions were delivered with two FPLC pumps at the same flow rates to a mixing T connector. A back pressure valve was used to adjust to the desired particle size. The resulting milky mixture was collected in a sterile glass bottle. This mixture was then diluted with an equal volume of citrate buffer, followed by equal volume of PBS (pH 7.4), and filtered through an ion-exchange membrane to remove any free siNA/carrier in the mixture. Ultra filtration against PBS (7.4)) was employed to remove ethanol and to exchange buffer. The final LNP was obtained by concentrating to the desired volume and sterile filtered through a 0.2 µm filter. The obtained LNPs were characterized in term of particle size, Zeta potential, alcohol content, total lipid content, nucleic acid encapsulated, and total nucleic acid concentration.

LNP Manufacture Process

In a non-limiting example, LNPs were prepared in bulk as follows. The process consisted of (1) preparing a lipid solution; (2) preparing an siNA/carrier solution; (3) mixing/particle formation; (4) incubation; (5) dilution; (6) ultrafiltration and concentration.

1. Preparation of Lipid Solution

2 L glass reagent bottles and measuring cylinders were depyrogenated. The lipids were warmed to room temperature. Into the glass reagent bottle was transferred 8.0 g of (13Z, 16Z)—N,N-dimethyl-3-nonyldocosa-13,16-dien-1-amine with a pipette and 1.2 g of DSPC, 3.5 g of Cholesterol, 0.9 g of PEG-DMG were added. To the mixture is added 1 L of ethanol. The reagent bottle was placed in heated water bath, at a temperature not exceeding 50° C. The lipid suspension was stirred with a stir bar. A thermocouple probe was put into the suspension through one neck of the round bottom flask with a sealed adapter. The suspension was heated at 30-40° C. until it became clear. The solution was allowed to cool to room temperature.

2. Preparation of siNA/Carrier Solution

Into a sterile container (Corning storage bottle) was weighed 0.4 g times the water correction factor (approximately 1.2) of siNA powder. The siNA was transferred to a depyrogenated 2 L glass reagent bottle. The weighing container was rinsed 3× with citrate buffer (20 mM, pH 5.0) and the rinses were placed into the 2 L glass bottle, QS with citrate buffer to 1 L. The concentration of the siNA solution was determined with a UV spectrometer using the following procedure. 20 µL was removed from the solution, diluted 50 times to 1000 µL, and the UV reading recorded at A260 nm after blanking with citrate buffer. This was repeated. Note, if the readings for the two samples are consistent, an average can be taken and the concentration calculated based on the extinction coefficients of the siNAs. If the final concentration is out of the range of 0.40±0.01 mg/mL, the concentration can be adjusted by adding more siNA/carrier powder, or adding more citrate buffer. This process can be repeated for the second siNA, if applicable When the siNA/carrier solution comprised a single siNA duplex instead of a cocktail of two or more siNA duplexes and/or carriers, then the siNA/carrier was dissolved in 20 mM citrate buffer (pH 5.0) to give a final concentration of 0.4 mg/mL.

The lipid and ethanol solutions were then sterile filtered through a Pall Acropak 20 0.8/0.2 µm sterile filter PN 12203 into a depyrogenated glass vessel using a Master Flex Peristaltic Pump Model 7520-40 to provide a sterile starting material for the encapsulation process. The filtration process was run at an 80 mL scale with a membrane area of 20 $cm^2$. The flow rate was 280 mL/minute. This process can be scaled by increasing the tubing diameter and the filtration area.

3. Particle Formation—Mixing Step

Using a two-barrel syringe driven pump (Harvard 33 Twin Syringe), the sterile lipid/ethanol solution and the sterile siNA/carrier or siNA/carrier cocktail/citrate buffer (20 mM citrate buffer, pH 5.0) solutions were mixed in a 0.5 mm ID T-mixer (Mixing Stage I) at equal, or nearly equal, flow rates. The resulting outlet LNP suspension contained 40-50 vol % ethanol. To obtain a 45 vol % ethanol outlet suspension, the sterile lipid/ethanol and the sterile siNA/carrier or siNA/carrier cocktail/citrate buffer solutions were mixed at flow rates of 54 mL/min and 66 mL/min, respectively, such that the total flow rate of the mixing outlet is 120 mL/min.

4. Dilution

The outlet stream of Mixing Stage I was fed directly into a 4 mm ID T-mixer (Mixing Stage 11), where it was diluted with a buffered solution at higher pH (20 mM sodium citrate, 300 mM sodium chloride, pH 6.0) at a ratio of 1:1 vol:vol %. This buffered solution was at a temperature in the range of 30-40° C., and was delivered to the 4 mm T-mixer via a peristaltic pump (Cole Parmer MasterFlex L/S 600 RPM) at a flow rate of 120 mL/min.

The outlet stream of Mixing Stage 11 was fed directly into a 6 mm ID T-mixer (Mixing Stage III), where it was diluted with a buffered solution at higher pH (PBS, pH 7.4) at a ratio of 1:1 vol:vol %. This buffered solution was at a temperature in the range of 15-25° C., and was delivered to the 6 mm T-mixer via peristaltic pump (Cole Parmer MasterFlex L/S 600 RPM) at a flow rate of 240 mL/min.

5. Incubation and Free siNA Removal

The outlet stream of Mixing Stage III was held after mixing for 30 minute incubation. The incubation was conducted at temperature of 35-40° C. and the in-process suspension was protected from light. Following incubation, free (un-encapsulated) siNA was removed via anion exchange with Mustang Q chromatography filters (capsules). Prior to use, the chromatography filters were pre-treated sequentially with flushes of 1N NaOH, 1M NaCl, and a final solution of 12.5 vol % ethanol in PBS. The pH of the final flush was checked to ensure pH <8. The incubated LNP stream was then filtered via Mustang Q filters via peristaltic pump (Cole Parmer MasterFlex L/S 600 RPM) at flow rate of approximately 100 mL/min. The filtered stream was received into a sterile glass container for ultrafiltration and concentration as follows.

6. Ultrafiltration, Concentration and Sterile Filtration

The ultrafiltration process is a timed process and the flow rates must be monitored carefully. This is a two step process; the first is a concentration step taking the diluted material and concentrating approximately 8-fold, to a concentration of approximately 0.3-0.6 mg/mL siNA.

In the first step, a ring-stand with a ultrafiltration membrane 100 kDa PES (Spectrum Labs) installed was attached to a peristaltic pump (Spectrum KrosFloII System). 9.2 L of sterile distilled water was added to the reservoir; 3 L was drained to waste and the remainder was drained through permeate to waste. 5.3 L of 0.25 N sodium hydroxide was added to the reservoir with 1.5 L drained to waste and 3.1 L drained through permeate to waste. The remaining sodium hydroxide was held in the system for sanitization (at least 10 minutes), and then the pump was drained. 9.2 L of 70 (v/v) % isopropyl alcohol was added to the reservoir with 1.5 L drained to waste and the remainder drained through permeate to waste. 6 L of conditioning buffer (12.5% ethanol in phosphate buffered saline) was added with 1.5 L drained to waste and the remainder drained though the permeate until the waste was of neutral pH (7-8). A membrane flux value was recorded, and the pump was then drained.

The diluted LNP solution was placed into the reservoir to the 1.1 L mark. The pump was turned on at 2.3 L/min. After 5 minutes of recirculation, the permeate pump was turned on at 62.5 mL/min and the liquid level was constant at approximately 950 mL in the reservoir. The diluted LNP solution was concentrated from 9.8 L to 1.1 L in 140 minutes, and the pump was paused when all the diluted LNP solution has been transferred to the reservoir.

The second step was a diafiltration step exchanging the ethanol/aqueous buffer to phosphate buffered saline. During this step, approximately 10-20 diafiltration volumes of phosphate buffered saline were used. Following diafiltration, a second concentration was undertaken to concentrate the LNP suspension 3-fold to approximately 1-1.5 mg/mL siRNA. The concentrated suspension was collected into sterile, plastic PETG bottles. The final suspension was then filtered sequentially via Pall 0.45 um PES and Pall 0.2 um PES filters for terminal sterilization prior to vial filling.

The obtained LNPs were characterized in terms of particle size, Zeta potential, alcohol content, total lipid content, nucleic acid encapsulated, and total nucleic acid concentration.

D. Synthesis of Novel Cationic Lipids

Synthesis of the novel cationic lipids is a linear process starting from lipid acid (i). Coupling to N,O-dimethyl hydroxylamine gives the Weinreb amide ii. Grignard addition generates ketone iii. Titanium mediated reductive amination gives final products of type iv.

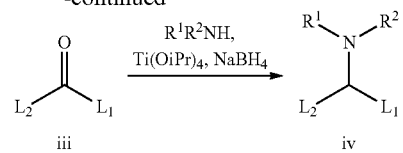

Synthesis of the single carbon homologated cationic lipids v is a linear process starting from lipid ketone (iii). Conversion of the ketone to the nitrile (iv) is accomplished via treatment with TOSMIC and potassium tert-butoxide. Reduction of the nitrile to the primary amine followed by reductive amination provides final cationic lipids v.

GENERAL SCHEME 2

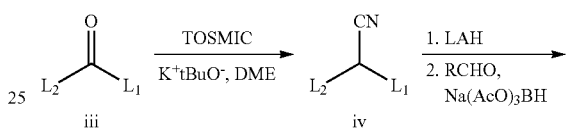

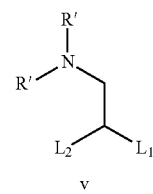

Synthesis of two carbon homologated cationic lipids viii is a linear process starting from lipid ketone (iii). Conversion of the ketone to the α,β-unsaturated amide vi is accomplished under Peterson conditions. Conjugate reduction of the α,β-unsaturation is performed using LS-Selectride to give amide vii. Reduction of the amide with lithium aluminum hydride provides final cationic lipids viii.

GENERAL SCHEME 1

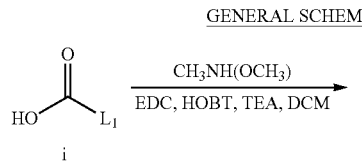

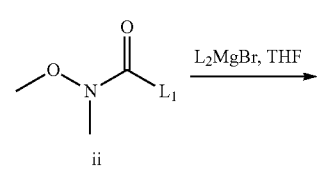

GENERAL SCHEME 3

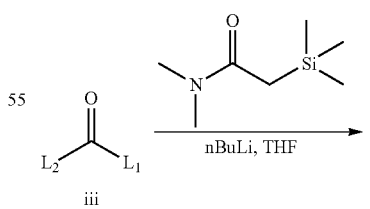

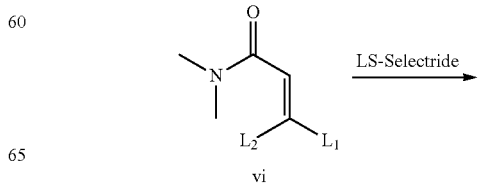

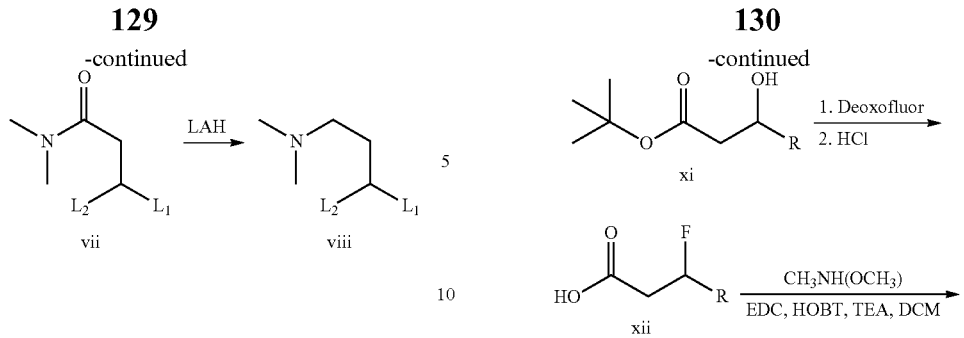

Cyclopropyl containing lipids are prepared according to General Scheme 4. Unsaturated Weinreb amides ii are subjected to Simmons-Smith cyclopropanation conditions to give cyclopropyl containing Weinreb amides ix. These are carried on to final products as outlined in General Schemes 1-3.

GENERAL SCHEME 4

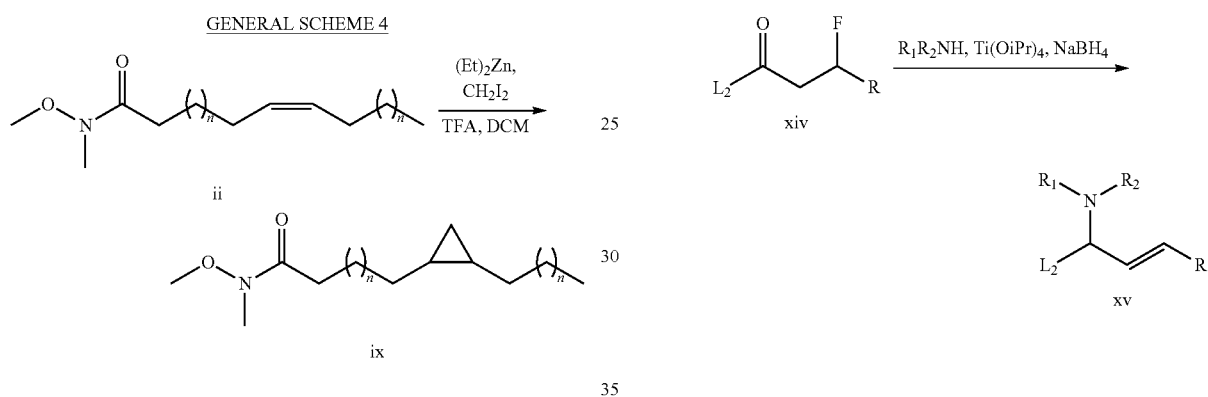

Synthesis of allylic amine cationic lipids xv is a linear process starting with aldehyde x. Addition of t-butyl aceate generates β-hydroxy ester xi. Conversion of the hydroxyl functionality to a fluoro group followed by acid treatment generates β-fluoro acid xii. Conversion of the acid to the Weinreb amide followed by Grignard addition gives the β-fluoro ketone xiv. Reductive amination results in simultaneous elimination to generate the desired allylic amine xv.

GENERAL SCHEME 5

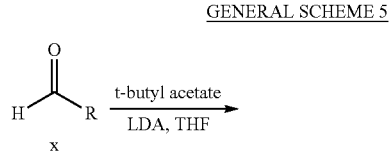

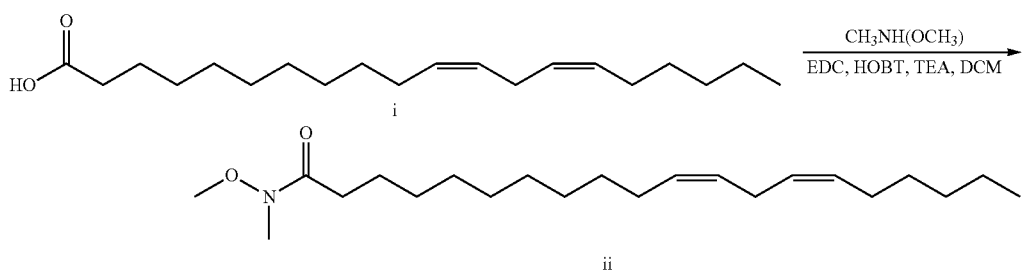

20,23-nonacosadien-10-amine, N,N-dimethyl-, (20Z,23Z) (Compound 1)

11,14-Eicosadienoic acid, (11Z,14Z)—(50 g, 162 mmol), N,O-Dimethylhydroxylamine hydrochloride (31.6 g, 324 mmol), HOAt (44.1 g, 324 mmol), Et₃N (45.2 mL, 324 mmol), and EDC (62.1 g, 324 mmol) were mixed in DCM (810 mL) and stirred overnight at ambient temperature. Reaction was then washed 5×700 mL water, then washed 1×600 mL 1M NaOH, dried with sodium sulfate, filtered through celite and evaporated to obtain 53.06 g (93%) 11,14-eicosadienamide, N-methoxy-N-methyl-, (11Z,14Z) as a clear golden oil. $^1$H NMR (400 MHz, CDCl₃) δ 5.35 (m, 4H), 3.68 (s, 3H), 3.18 (s, 3H), 2.77 (m, 2H), 2.41 (t, J=7 Hz, 2H), 2.05 (m, 4H), 1.63 (m, 2H), 1.40-1.26 (m, 18H), 0.89 (t, J=7 Hz, 3H).

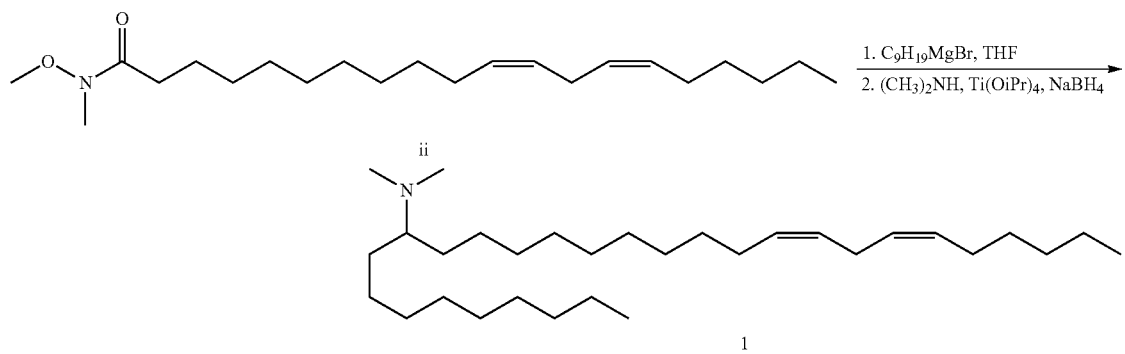

11,14-eicosadienamide, N-methoxy-N-methyl-, (11Z,14Z)-1 (4 g, 11.38 mmol) was dissolved in dry THF (50.0 ml) in a 250 mL flask then 1 M nonylmagnesium bromide (22.76 ml, 22.76 mmol) was added under nitrogen at ambient temperature. After 10 min, the reaction was slowly quenched with excess sat. aq $NH_4Cl$. The reaction was washed into a separatory funnel with hexane and water, shaken, the lower aqueous layer discarded, the upper layer dried with sodium sulfate, filtered, and evaporated to give crude ketone as a golden oil. To the above crude ketone was added dimethylamine (2 M in THF) (14.22 ml, 28.4 mmol) followed by Ti(O-i-Pr)$_4$ (6.67 ml, 22.76 mmol) and let stir overnight. The next day, added EtOH (50 ml) followed by $NaBH_4$ (0.646 g, 17.07 mmol). After 5 min of stirring, directly injected entire reaction onto a 40 g silica column that was in line with a 330 g silica column. Eluted 10 min 100% DCM, then 30 min 0-15% MeOH/DCM, collected 20,23-nonacosadien-10-amine, N,N-dimethyl-, (20Z,23Z) (1) (2.45 g, 5.47 mmol, 48.1% yield) as a faintly golden oil. $^1$H NMR (400 MHz, CDCl$_3$) δ 5.35 (m, 4H), 2.78 (m, 2H), 2.23 (m, 1H), 2.21 (s, 6H), 2.05 (m, 4H), 1.45-1.16 (m, 38H), 0.89 (m, 6H). HRMS calcd for C31H61N 448.4877, found 448.4872.

Compounds 2-30 are novel cationic lipids and were prepared according to the General Scheme 1 above.

| Compound | Structure | HRMS |
|---|---|---|
| 2 | 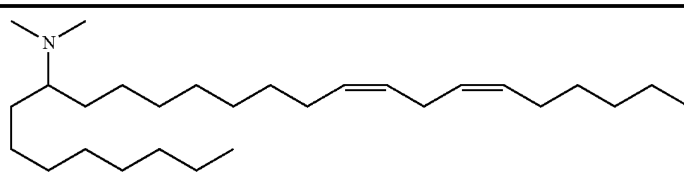 | calcd C28H56N 406.4407, found 406.4405. |
| 3 | 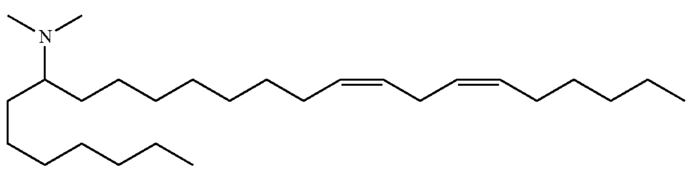 [SMILES: CCCCC/C=C\C/C=C\CCCCCCCC(CCCCCCC)N(C)C] | calcd C27H54N 392.4251, found 392.4250. |
| 4 | 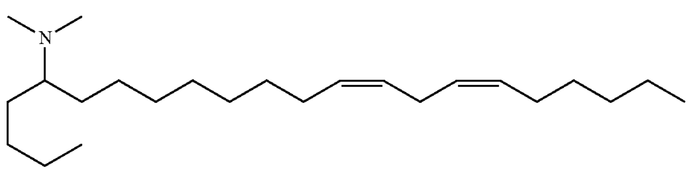 [SMILES: CCCCC/C=C\C/C=C\CCCCCCCC(CCCC)N(C)C] | calcd C24H48N 350.3781, found 350.3770. |
| 5 | 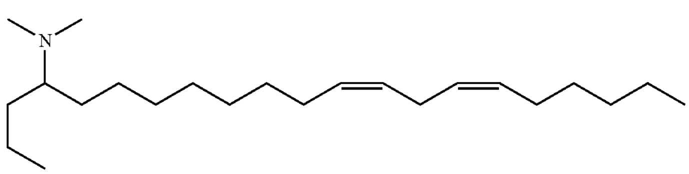 [SMILES: CCCCC/C=C\C/C=C\CCCCCCCC(CCC)N(C)C] | calcd C23H46N 336.3625, found 336.3613. |
| 6 | 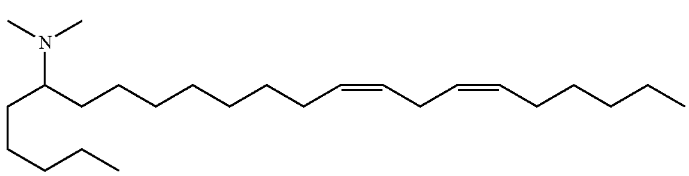 [SMILES: CCCCC/C=C\C/C=C\CCCCCCCC(CCCCC)N(C)C] | calcd C25H50N 364.3938, found 364.3941. |

-continued
| Compound | Structure | HRMS |
|---|---|---|
| 7 | 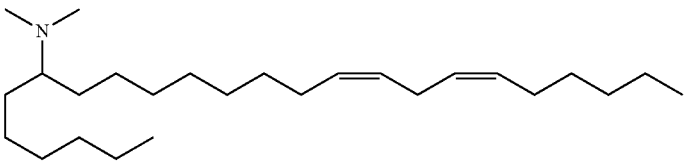 [SMILES: CCCCC/C=C\C/C=C\CCCCCCCC(CCCCCC)N(C)C] | calcd C26H52N 378.4094, found 378.4081. |
| 8 | 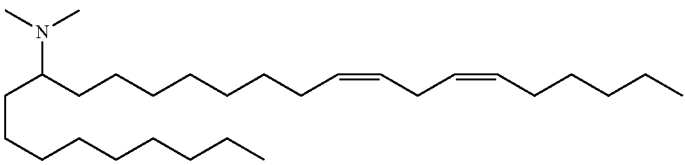 [SMILES: CCCCC/C=C\C/C=C\CCCCCCCC(CCCCCCCCC)N(C)C] | calcd C29H58N 420.4564, found 420.4562. |
| 9 | 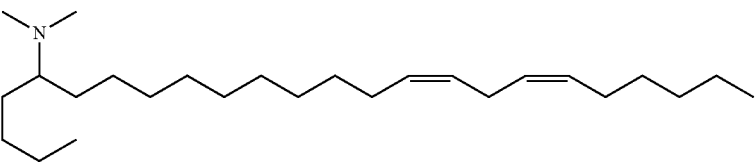 [SMILES: CCCCC/C=C\C/C=C\CCCCCCCCCC(CCCC)N(C)C] | calcd C26H52N 378.4094, found 378.4089. |
| 10 | 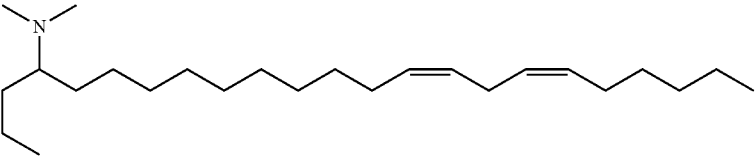 [SMILES: CCCCC/C=C\C/C=C\CCCCCCCCCC(CCC)N(C)C] | calcd C25H50N 364.3938, found 364.3931. |
| 11 | 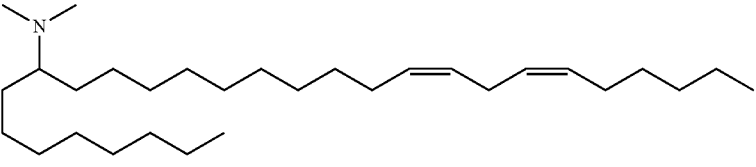 [SMILES: CCCCC/C=C\C/C=C\CCCCCCCCCC(CCCCCCCC)N(C)C] | calcd C30H60N 434.4720, found 434.4717. |
| 12 | 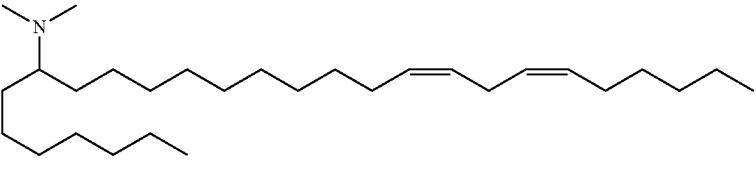 [SMILES: CCCCC/C=C\C/C=C\CCCCCCCCCC(CCCCCCC)N(C)C] | calcd C29H58N 420.4564, found 420.4561. |
| 13 | 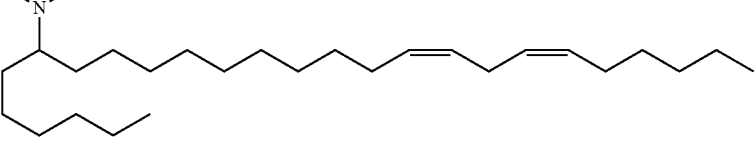 | calcd C28H56N 406.4407, found 406.4404. |
| 14 | 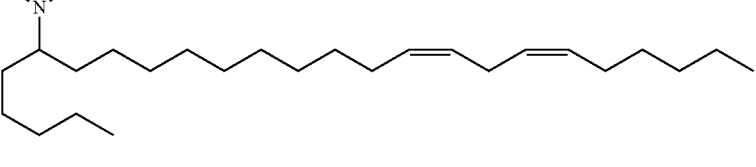 | calcd C27H54N 392.4251, found 392.4245. |
| 15 | 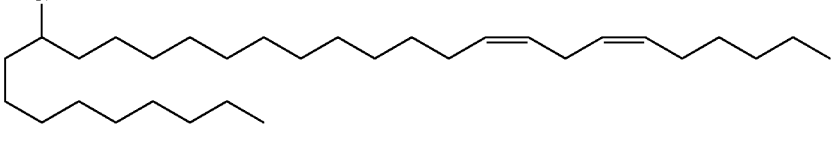 | calcd C33H66N 476.5190, found 476.5196. |

-continued

| Compound | Structure | HRMS |
|---|---|---|
| 16 | 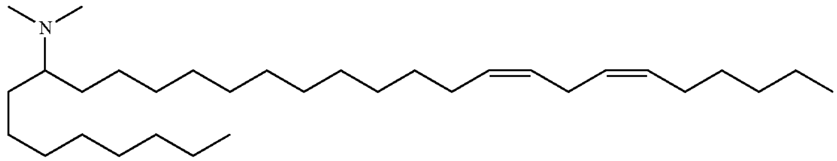 [SMILES: CCCCC/C=C\C/C=C\CCCCCCCCCCCC(CCCCCCCC)N(C)C] | calcd C32H64N 462.5033, found 462.5045. |
| 17 | 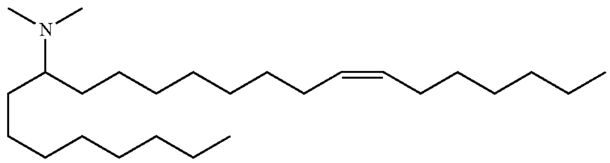 [SMILES: CCCCCC/C=C\CCCCCCCC(CCCCCCCC)N(C)C] | calcd C29H59N 422.4720, found 422.4726. |
| 18 | 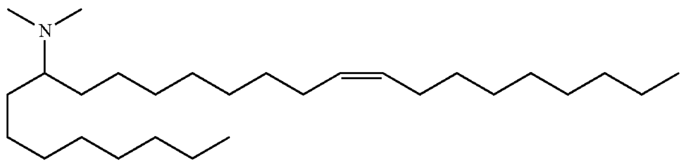 [SMILES: CCCCCCCC/C=C\CCCCCCCC(CCCCCCCC)N(C)C] | calcd C28H57N 408.4564, found 408.4570. |
| 19 | 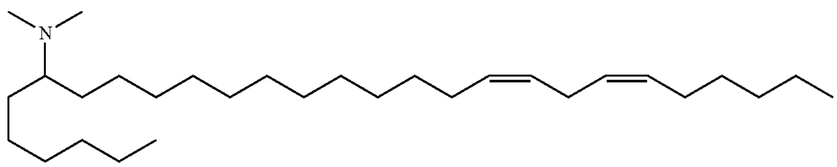 [SMILES: CCCCC/C=C\C/C=C\CCCCCCCCCCCC(CCCCCC)N(C)C] | calcd C30H59N 434.4720, found 434.4729. |
| 20 | 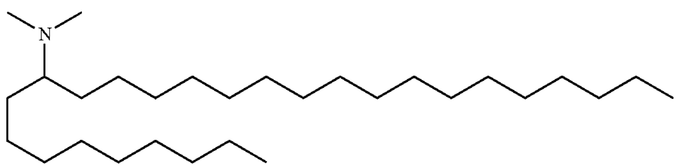 [SMILES: CCCCCCCCCCCCCCCCCC(CCCCCCCCC)N(C)C] | calcd C29H61N 424.4877, found 424.4875. |
| 21 | 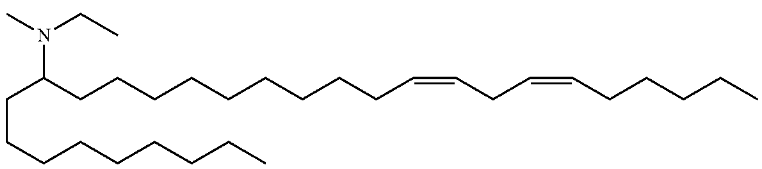 [SMILES: CCCCC/C=C\C/C=C\CCCCCCCCCC(CCCCCCCCC)N(C)CC] | calcd C32H64N 462.5033, found 462.5023. |
| 22 | 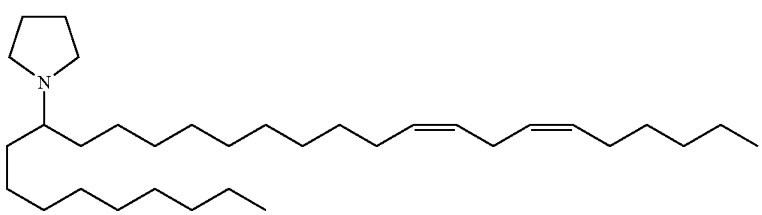 [SMILES: CCCCC/C=C\C/C=C\CCCCCCCCCC(CCCCCCCCC)N1CCCC1] | calcd C33H64N 474.5033, found 474.5033. |
| 23 | 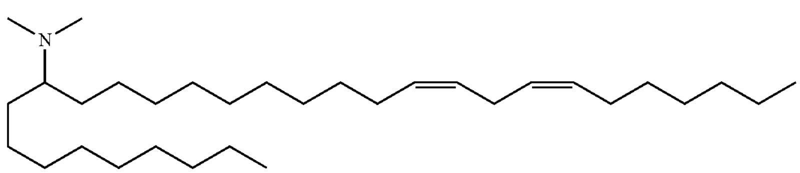 [SMILES: CCCCCC/C=C\C/C=C\CCCCCCCCCC(CCCCCCCCC)N(C)C] | calcd C29H60N 422.4720, found 422.4716. |
| 24 | 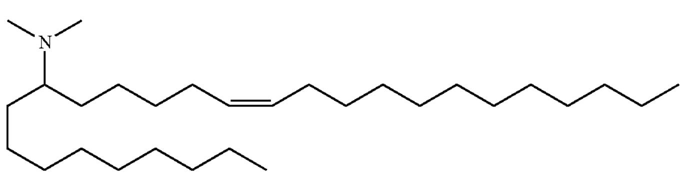 [SMILES: CCCCCCCCCCC/C=C\CCCCC(CCCCCCCCC)N(C)C] | calcd C29H60N 422.4720, found 422.4718. |

| Compound | Structure | HRMS |
|---|---|---|
| 25 | 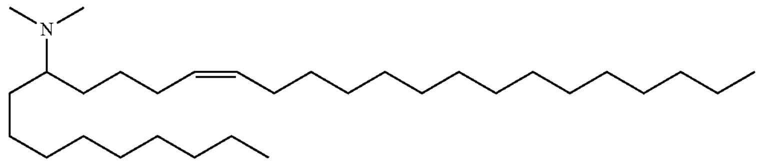 [SMILES: CCCCCCCCCCCCCC/C=C\CCCC(CCCCCCCCC)N(C)C] | calcd C31H64N 450.5033, found 450.5031. |
| 26 | 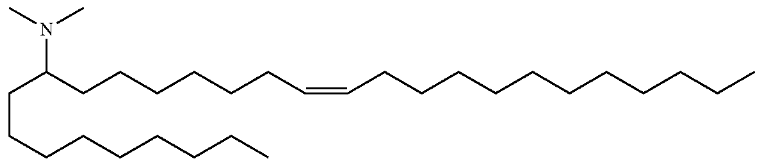 [SMILES: CCCCCCCCCCC/C=C\CCCCCCC(CCCCCCCCC)N(C)C] | calcd C31H64N 450.5033, found 450.5034. |
| 27 | 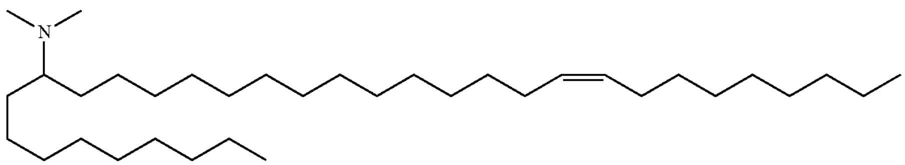 [SMILES: CCCCCCCC/C=C\CCCCCCCCCCCCCC(CCCCCCCCC)N(C)C] | calcd C35H72N 506.5659, found 506.5635. |
| 28 | 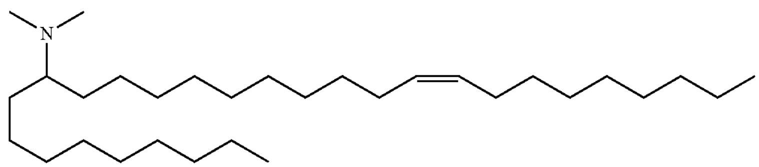 [SMILES: CCCCCCCC/C=C\CCCCCCCCCC(CCCCCCCCC)N(C)C] | calcd C31H64N 450.5033, found 450.5037. |
| 29 | 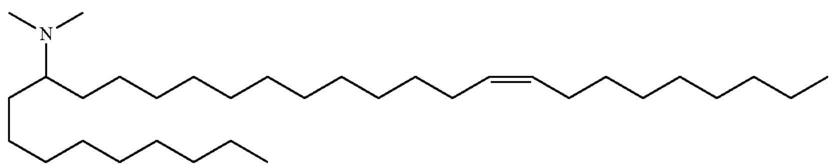 [SMILES: CCCCCCCC/C=C\CCCCCCCCCCCC(CCCCCCCCC)N(C)C] | calcd C33H68N 478.5346, found 478.5358. |
| 30 | 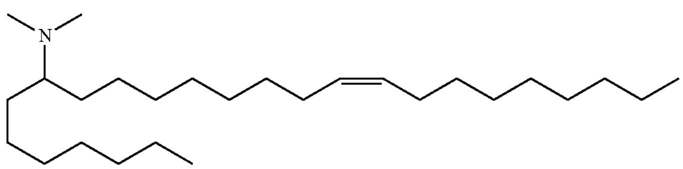 [SMILES: CCCCCCCC/C=C\CCCCCCCC(CCCCCCC)N(C)C] | calcd C27H56N 394.4407, found 394.4407. |
(12Z,15Z)—N,N-dimethyl-2-nonylhenicosa-12,15-dien-1-amine (Compound 31)
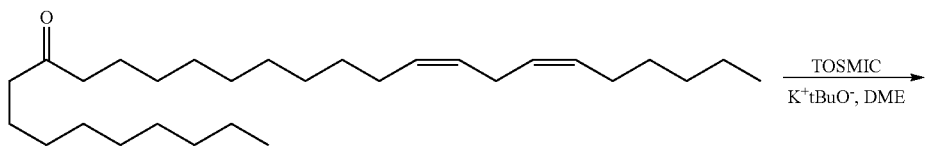
iii
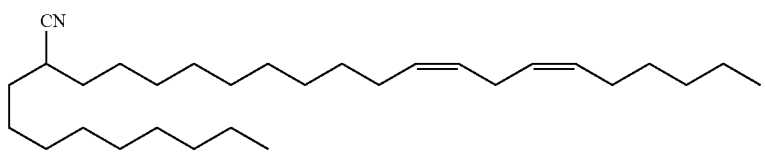
iv A solution of keton iii (4.0 g, 9.55 mmol), TOSMIC (2.4 g, 12.4 mmol) in dimethoxyethane (45 mL) was cooled to 0° C. and treated with potassium tert-butoxide (19.1 mmol, 19.1 mL of a 1M solution in tBuOH). After 90 minutes, the reaction was partitioned between hexanes and water. The organics were washed with water, dried over sodium sulfate, filtered and evaporated in vacuo. This material was purified by flash chromatography (0-5% EtOAc/hexanes) to give desired product (containing ~20% of s.m.). This mixture was carried into next step as is. LC/MS (M+H)=430.6.

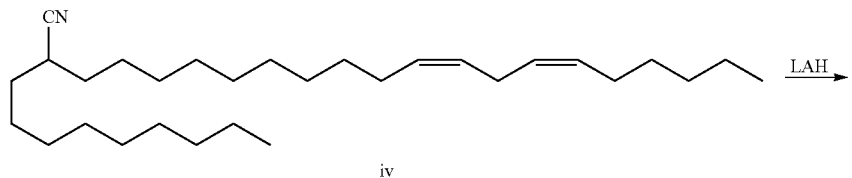

iv

Lithium aluminum hydride (23.9 mmol, 23.9 mL of a 1M solution in THF) was added directly to nitrile iv (3.42 g, 8 mmol) at ambient temperature and the reaction was stirred for 20 minutes. The reaction was diluted with 100 mL THF, cooled to 0° C. and carefully quenched with sodium sulfate decahydrate solution. The solids were filtered off and washed with THF. The filtrate was evaporated in vacuo and carried directly into next reaction crude. LC/MS (M+H)=434.6.

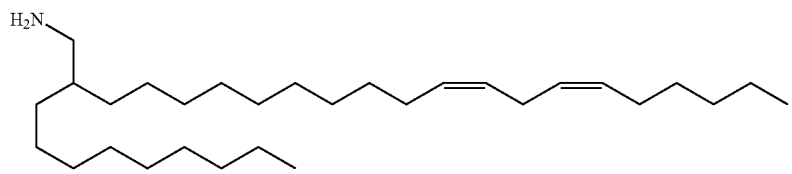

A solution of primary amine (3.45 g, 6.2 mmol) in dichloroethane (100 mL) was treated with formaldehyde (1.6 mL, 21.7 mmol) followed by sodium triacetoxyborohydride (6.6 g, 31 mmol). After 5 minutes, the reaction was partitioned between dichloromethane and 1N NaOH. The organics were dried over sodium sulfate, filtered and evaporated in vacuo. The crude mixture was purified by reverse phase preparative chromatography (C8 column) to provide (12Z,15Z)—N,N-dimethyl-2-nonylhenicosa-12,15-dien-1-amine. HRMS calc'd 462.5033, found 462.5026. $^1$H NMR (400 MHz, CDCl$_3$) δ 5.35 (m, 4H), 2.78 (2H, t, J=5.6 Hz), 2.18 (s, 6H), 2.05 (m, 6H), 1.3 (m, 39H), 0.89 (m, 6H).

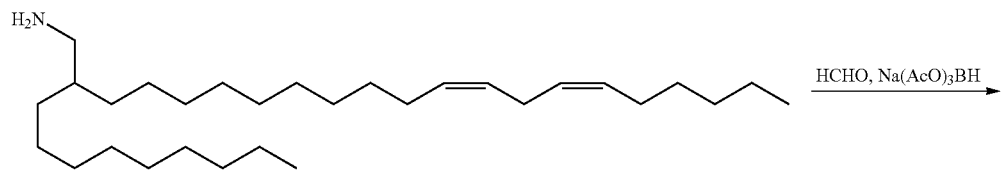

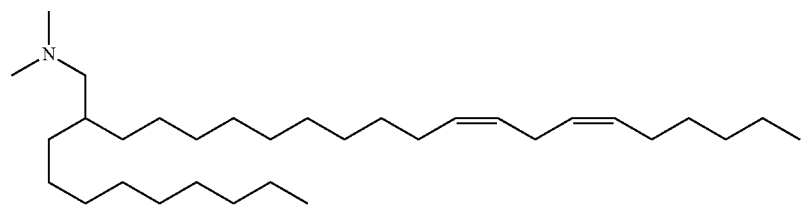

(13Z,16Z)—N,N-dimethyl-3-nonyldocosa-13,16-dien-1-amine (Compound 32)

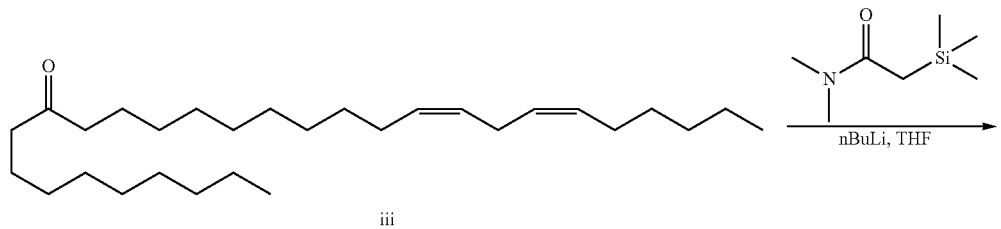

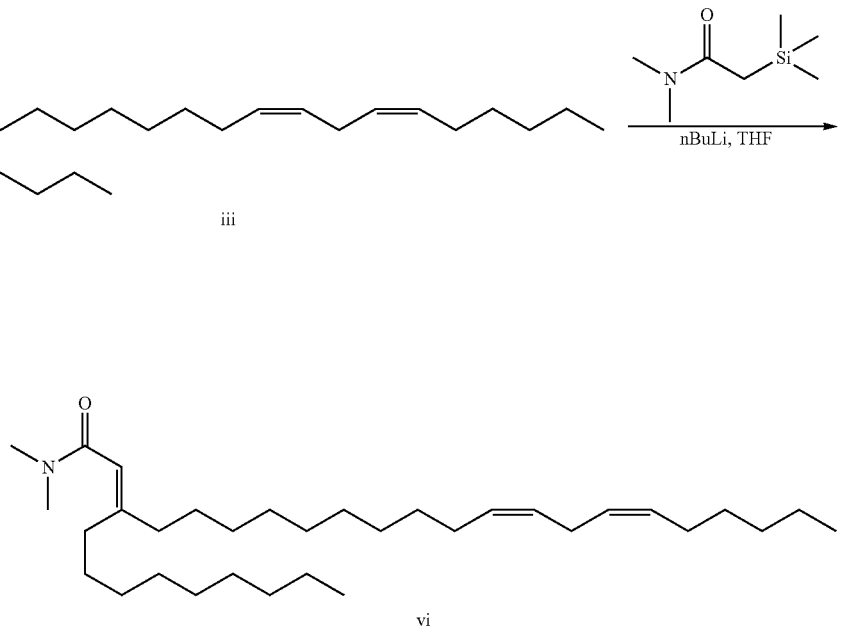

The silyl amide Peterson reagent (3.1 g, 16.7 mmol) was dissolved in THF (35 mL) and cooled to −63° C. To this solution was added nBuLi (16.7 mmol, 6.7 mL of a 2.5M solution). The reaction was warmed to ambient temperature for 30 minutes. The ketone (5.0 g, 11.9 mmol) was dissolved in THF (25 mL) in a second flask. The Peterson reagent was transferred to the ketone solution at −60° C. The reaction was warmed to −40° C. for 1 hour, then warmed to 0° C. for 30 minutes. The reaction was quenched with sodium bicarbonate, diluted with additional water and partitioned between water/hexanes. The organics were washed with brine, dried over sodium sulfate, filtered and evaporated in vacuo. Purification by flash chromatography (0-40% MTBE/hexanes) gave α,β-unsaturated amide vi. $^1$H NMR (400 MHz, CDCl$_3$) δ 5.75 (s, 1H), 5.36 (m, 4H), 3.01 (s, 3H), 2.99 (s, 3H), 2.78 (t, 2H), 2.28 (t, 2H), 2.05 (m, 6H), 1.35 (m, 34H), 0.89 (m, 6H).

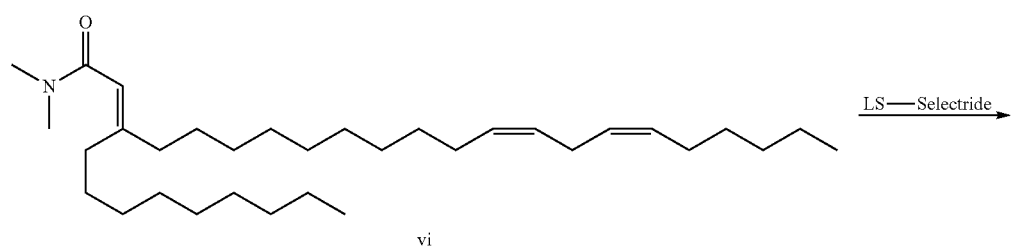

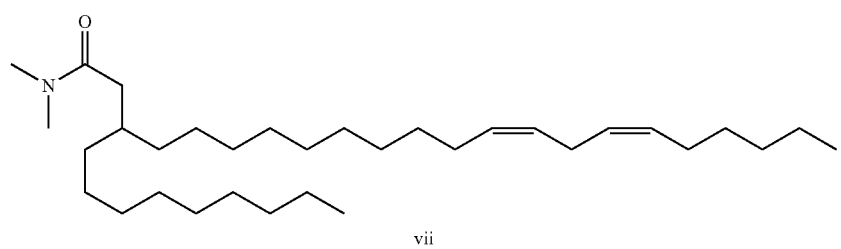

α,β-unsatured amide vi (1 g, 2.1 mmol) and LS-Selectride (4.1 mmol, 4.1 mL of a 1M solution) were combined in a sealed tube and heated to 60° C. for 24 hours. The reaction was cooled to ambient temperature and partitioned between ammonium chloride solution and heptane. The organics were dried over sodium sulfate, filtered and evaporated in vacuo to give amide vii. This intermediate was carried directly into next reaction crude.

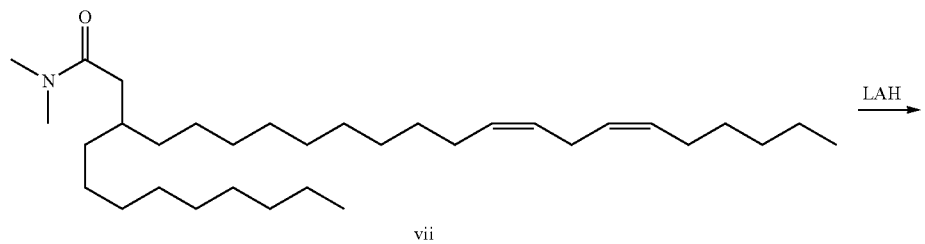

vii

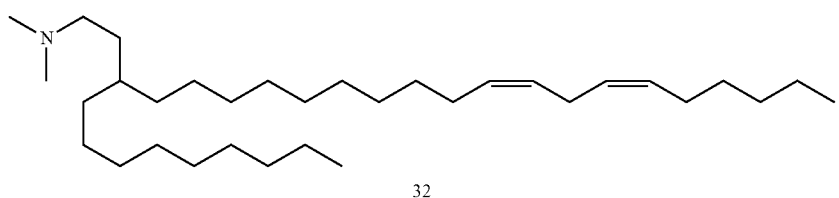

32

To a solution of amide vii (2.85 g, 5.8 mmol) was added lithium aluminum hydride (8.7 mmol, 8.7 mL of a 1M solution). The reaction was stirred at ambient temperature for 10 minutes then quenched by slow addition of sodium sulfate decahydrate solution. The solids were filtered and washed with THF and the filtrate evaporated in vacuo. The crude mixture was purified by reverse phase preparative chromatography (C8 column) to provide (13Z,16Z)—N,N-dimethyl-3-nonyldocosa-13,16-dien-1-amine (Compound 32) as an oil. HRMS (M+H) calc'd 476.5190, found 476.5189. $^1$H NMR (400 MHz, CDCl$_3$) δ 5.37 (m, 4H), 2.78 (t, 2H), 2.42 (m, 8H), 2.05 (q, 4H), 1.28 (m, 41H), 0.89 (m, 6H).

N,N-dimethyl-1-(2-octylcyclopropyl)heptadecan-8-amine (Compound 33)

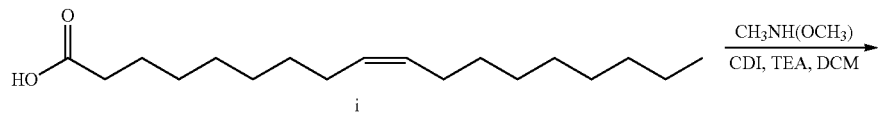

i

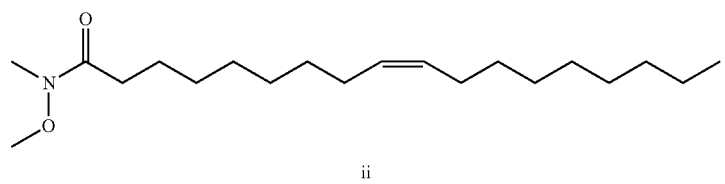

ii

To a solution of oleic acid (1 g, 3.5 mmol) in DCM (500 mL) cooled to 0° C. was added CDI (0.63 g, 3.9 mmol). The reaction was warmed to ambient temperature for 30 minutes before cooling to 0° C. and treating first with triethylamine (0.39 g, 3.9 mmol) and then dimethyl hydroxylamine hydrochloride (0.38 g, 3.9 mmol). After 1 hour the reaction was partitioned between water and heptane. The organics were dried over magnesium sulfate, filtered and evaporate in vacuo to give crude Weinreb amide ii which was carried directly into next reaction.

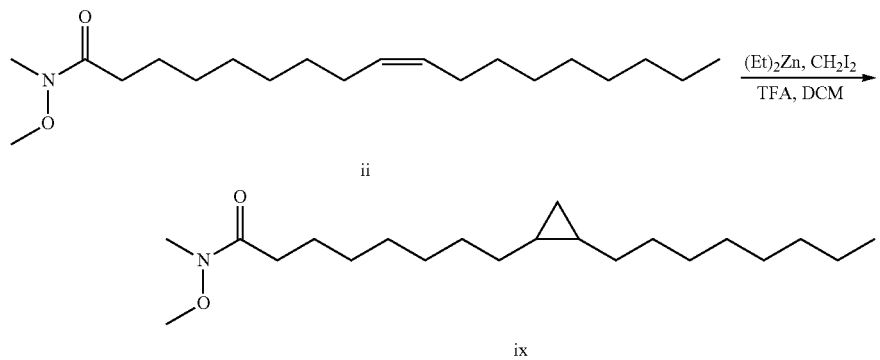

A solution of diethylzinc (70.3 mmol, 70.3 mL of a 1M solution) in dichloromethane (130 mL) was cooled to −1° C. and treated dropwise with TFA (8.0 g, 70.3 mmol). After 30 minutes, diiodomethane (18.8 g, 70.3 mmol) was added and this was aged for 30 minutes in the ice bath. To this solution was added Weinreb amide ii (7.6 g, 23.4 mmol). The reaction was warmed to ambient temperature and stirred for 1 hour. The reaction was quenched with ammonium chloride solution (100 mL) and organic layer partitioned off, washed with 10% sodium thiosulfate, dried over magnesium sulfate, filtered and evaporated in vacuo. Purification was flash chromatography (0-30% MTBE/heptane) gave desired product ix. $^1$H NMR (400 MHz, CDCl$_3$) δ 3.72 (s, 3H), 3.22 (s, 3H), 2.48 (t, 2H), 1.65 (m, 2H), 1.39 (m, 22H), 1.18 (m, 2H), 0.91 (t, 3H), 0.68 (m, 2H), 0.59 (m, 1H), −0.32 (m, 1H).

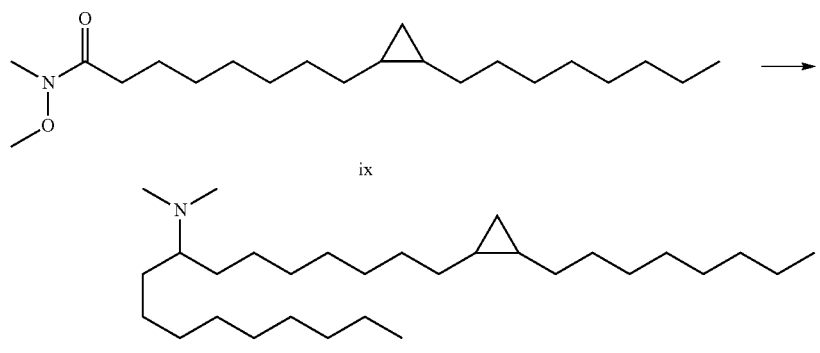

Conversion of Weinreb amide ix to Compound 33 was carried out in a manner analogous to that described for Compound 1 above (nonyl Grignard addition followed by reductive amination). LC/MS (M+H)=436.6. $^1$H NMR (400 MHz, CDCl$_3$) δ 2.25 (s, 6H), 1.30 (m, 45H), 0.91 (m, 6H), 0.68 (m, 2H), 0.59 (m, 1H), −0.31 (m, 1H).

Compounds 34-43 are novel cationic lipids and were prepared according to General Schemes 1-4 above.

| Compound | Structure | HRMS |
|---|---|---|
| 34 | 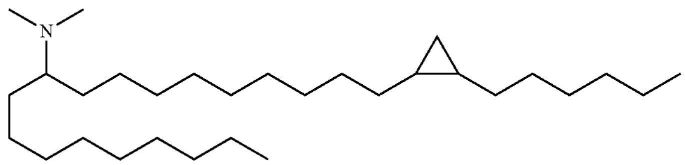 [SMILES: CCCCCCCCCC(CCCCCCCCCC1CC1CCCCCC)N(C)C] | calcd C30H62N 436.4877, found 436.4872. |
| 35 | 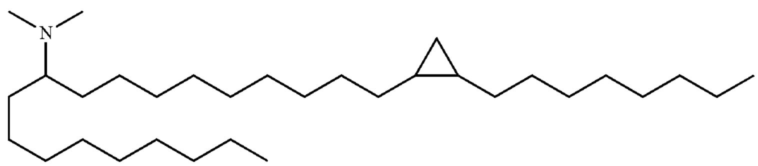 [SMILES: CCCCCCCCCC(CCCCCCCCCC1CC1CCCCCCCC)N(C)C] | calcd C32H66N 464.5190, found 464.5186. |
| 36 | 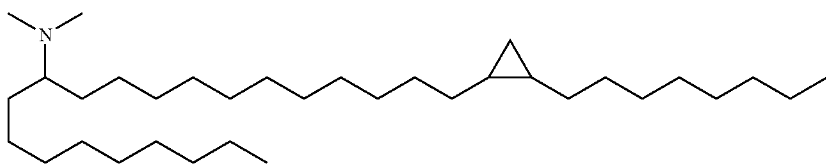 [SMILES: CCCCCCCCCC(CCCCCCCCCCCC1CC1CCCCCCCC)N(C)C] | calcd C34H70N 492.5503, found 492.5496. |
| 37 | 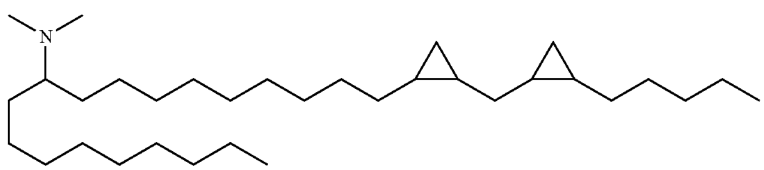 [SMILES: CCCCCCCCCC(CCCCCCCCCC1CC1CC1CC1CCCCC)N(C)C] | calcd C33H66N 476.5190, found 476.5174. |
| 38 | 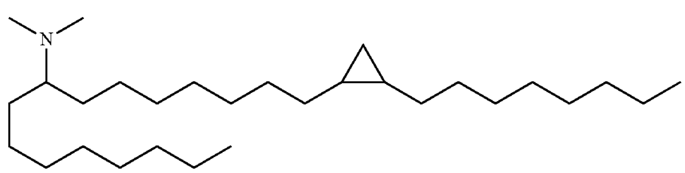 [SMILES: CCCCCCCCC1CC1CCCCCCCC(CCCCCCCC)N(C)C] | calcd C29H60N 422.4720, found 422.4701. |
| 39 | 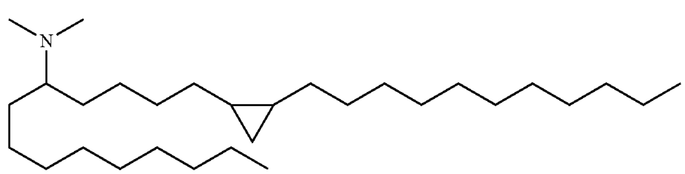 [SMILES: CCCCCCCCCCCC1CC1CCCCC(CCCCCCCCC)N(C)C] | calcd C30H62N 436.4877, found 436.4880. |
| 40 | 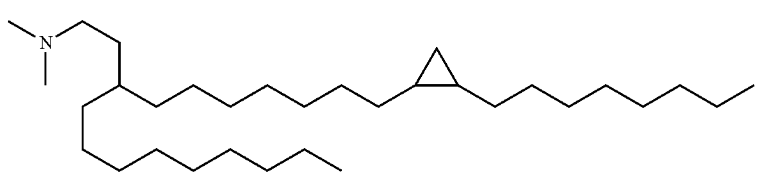 [SMILES: CCCCCCCCCC(CCCCCCCC1CC1CCCCCCCC)CCN(C)C] | calcd C32H66N 464.5190, found 464.5199. |

-continued

| Compound | Structure | HRMS |
|---|---|---|
| 41 | 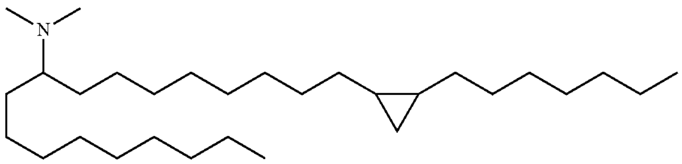 [SMILES: CCCCCCCCCC(CCCCCCCCC1CC1CCCCCCC)N(C)C] | calcd C30H62N 436.4877, found 436.4877. |
| 42 | 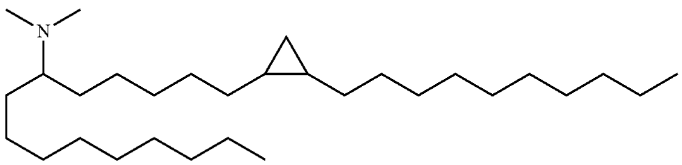 [SMILES: CCCCCCCCCCC1CC1CCCCCC(CCCCCCCCC)N(C)C] | calcd C30H62N 436.4877, found 436.4875. |
| 43 | 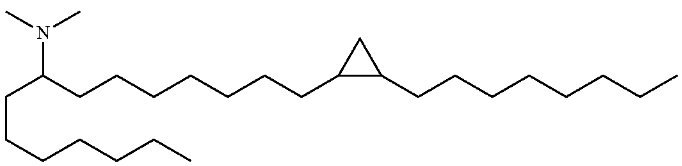 [SMILES: CCCCCCCCC1CC1CCCCCCCC(CCCCCCC)N(C)C] | LC/MS (M + H) 408.6. |

(11E,20Z,23Z)—N,N-dimethylnonacosa-11,20,23-trien-10-amine (Compound 44)

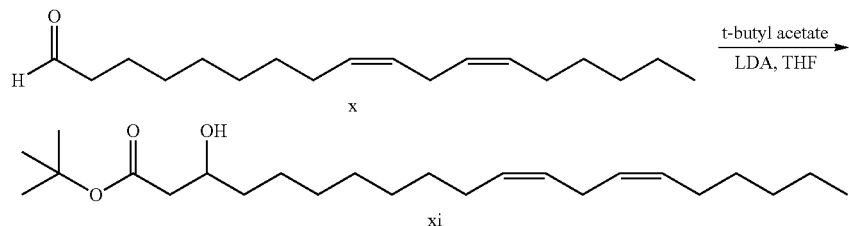

To a solution of LDA (95 mmol, 47.5 mL of a 2M solution) in THF (127 mL) cooled to −78° C. was added t-butyl acetate. The reaction was stirred for 15 minutes followed by addition of aldehyde x. The reaction was immediately quenched with ammonium chloride solution, warmed to ambient temperature and partitioned between water/pentane. The organics were dried over sodium sulfate, filtered and evaporated in vacuo. LC/MS (M+H-tBu)=325.4.

to ambient temperature with stirring for 16 hours followed by quenching with sodium bicarbonate solution. The reaction was partitioned and the organics dried over sodium sulfate, filtered and evaporate in vacuo. Flash column chromotagraphy (0-5% ethyl acetate/hexanes) gave the -fluoro ester.

Fluoro ester intermediate (6 g, 15.6 mmol) in dichloromethane was treated with hydrogen chloride (157 mmol, 39.2 mL of a 4M solution in dioxane) and the reaction was

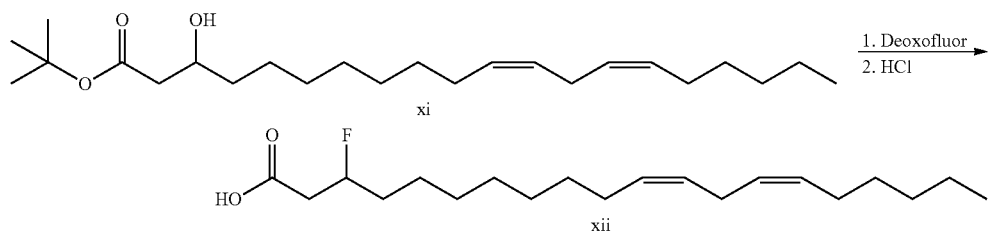

Hydroxy ketone xi (7 g, 18.4 mmol) was dissolved in dichloromethane (150 mL) and cooled to 0° C. and treated with deoxofluor (7.3 g, 33.1 mmol). The reaction was warmed stirred at ambient temperature for 16 hours. The reaction was evaporated in vacuo to give desired β-fluoro acid xii. LC/MS (M+H)=327.3.

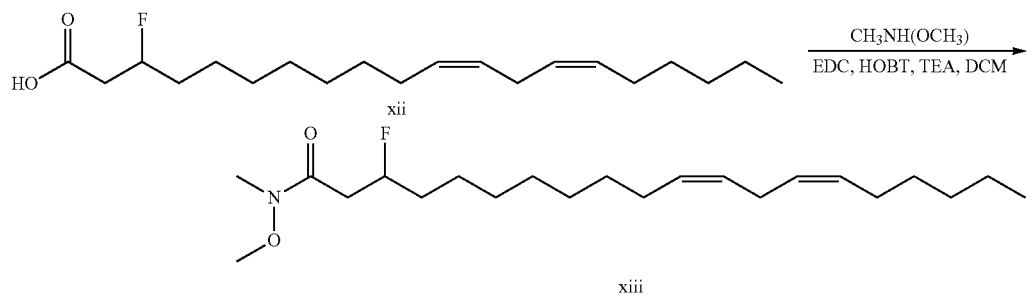

Fluoro carboxylic acid xii (5.1 g, 15.7 mmol), EDC (6.0 g, 31.4 mmol), N,O-dimethylhydroxylamine hydrochloride (3.1 g, 31.4 mmol), trimethylamine (4.0 g, 39.2 mmol), and HOAt (4.3 g, 31.4 mmol) were combined in DCM (78 mL) and stirred at ambient temperature for 16 hours. The reaction was partitioned between water/DCM and the organics were washed with water (3×) and NaOH solution (1×), dried over sodium sulfate, filtered and evaporated in vacuo.

Crude material was purified by reverse phase preparative chromatography to give desired Weinreb amide xiii LC/MS (M+H)=370.4.

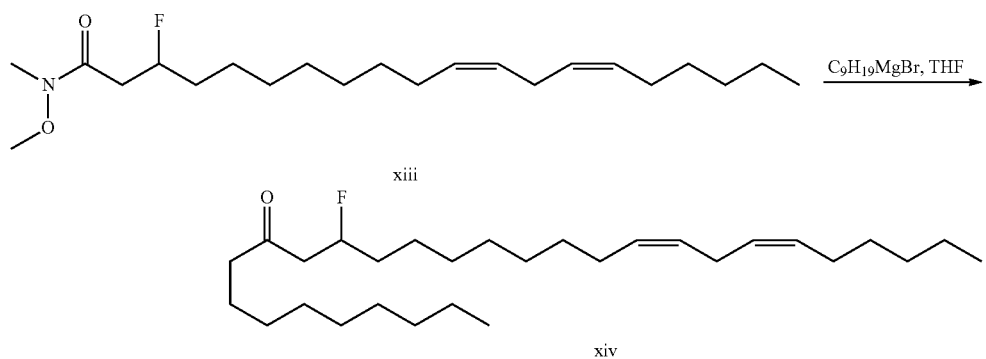

A solution of Weinreb amide xiii (4.3 g, 11.7 mmol) in THF (50 mL) was treated with nonylmagnesium bromide (23.4 mmol, 23.4 mL of a 1M solution) at ambient temperature. The reaction was quenched with ammonium chloride solution after 1 hour and partitioned between water and pentane. The organics were dried over sodium sulfate, filtered and evaporated in vacuo. This material was carried into next step crude.

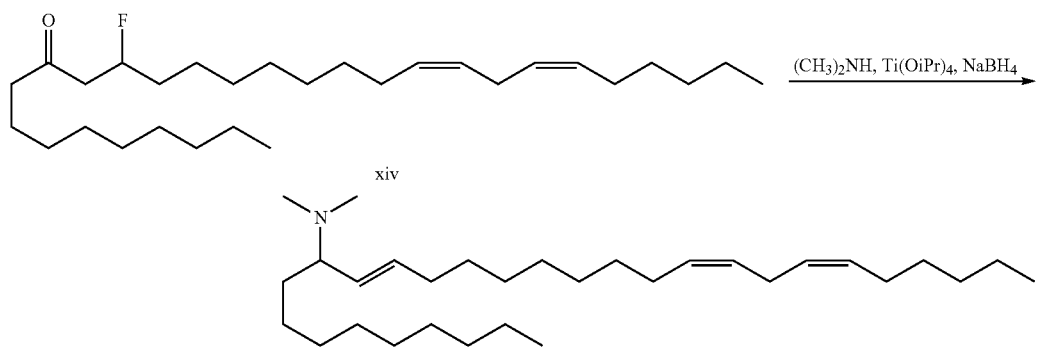

Ketone xiv (5.1 g, 11.7 mmol) was treated with dimethylamine (29.3 mmol, 14.7 mL of a 2M solution in THF) and titanium(IV) isopropoxide (6.7 g, 23.5 mmol) and the reaction was stirred at ambient temperature for 16 hours. To the reaction mixture was added ethanol (50 mL) followed by sodium borohydride (0.67 g, 17.6 mmol). The reaction was loaded directly onto a silica column and purified by flash chromatography (0-15% MeOH/DCM). The material required a second purification by preparative reverse phase chromatography to give (11E,20Z,23Z)—N,N-dimethyl-nonacosa-11,20,23-trien-10-amine. HRMS calc'd 446.4720, found 446.4724. $^1$H NMR (400 MHz, CDCl$_3$) δ 5.48 (m, 1H), 5.37 (m, 4H), 5.23 (m, 1H), 2.78 (t, 2H), 2.58 (m, 1H), 2.22 (s, 6H), 2.04 (m, 6H), 1.56 (m, 1H), 1.30 (m, 31H), 0.89 (m, 6H).

Compound 45 is DLinKC2DMA as described in *Nature Biotechnology*, 2010, 28, 172-176, WO 2010/042877 A1, WO 2010/048536 A2, WO 2010/088537 A2, and WO 2009/127060 A1.

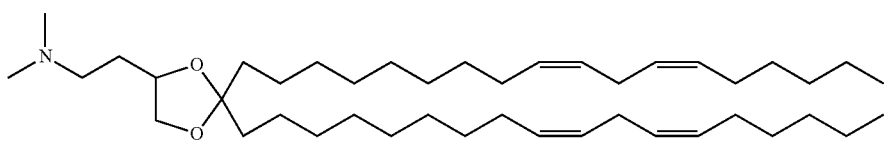

(45)

Compound 46 is MC3 as described in WO 2010/054401, and WO 2010/144740 A1.

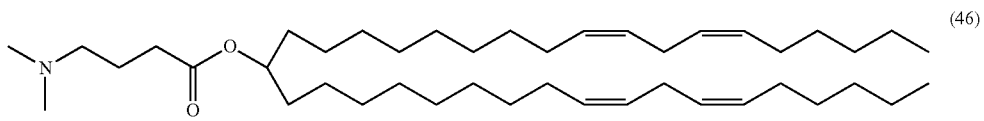 [SMILES: CCCCC/C=C\C/C=C\CCCCCCCCC(CCCCCCCC/C=C\C/C=C\CCCCC)OC(=O)CCCN(C)C]

(46)

E. Lipid Nanoparticle Compositions

The following lipid nanoparticle compositions (LNPs) of the instant invention are useful for the delivery of oligonucleotides, specifically siNA molecules of the invention:
Cationic Lipid/Cholesterol/PEG-DMG 56.6/38/5.4;
Cationic Lipid/Cholesterol/PEG-DMG 60/38/2;
Cationic Lipid/Cholesterol/PEG-DMG 67.3/29/3.7;
Cationic Lipid/Cholesterol/PEG-DMG 49.3/47/3.7;
Cationic Lipid/Cholesterol/PEG-DMG 50.3/44.3/5.4;
Cationic Lipid/Cholesterol/PEG-C-DMA/DSPC 40/48/2/10;
Cationic Lipid/Cholesterol/PEG-DMG/DSPC 40/48/2/10; and
Cationic Lipid/Cholesterol/PEG-DMG/DSPC 58/30/2/10.

One skilled in the art would readily appreciate that the present invention is well adapted to carry out the objects and obtain the ends and advantages mentioned, as well as those inherent therein. The methods and compositions described herein, as presently representative of preferred embodiments, are exemplary and are not intended as limitations on the scope of the invention. Changes therein and other uses will occur to those skilled in the art, which are encompassed within the spirit of the invention, are defined by the scope of the claims.

TABLE 7

| HBV Accession Numbers |
|---|
| X02763 - SEQ ID NO: 504 |
| Hepatitis b virus genome (serotype adw2) |

TABLE 7-continued

| HBV Accession Numbers |
|---|
| X02763.1 GI:59418 |
| X69798 - SEQ ID NO: 505 |
| Hepatitis B virus, subtype adw4 genes |
| X69798.1 GI:59422 |
| X65259 - SEQ ID NO: 506 |
| Hepatitis B virus (ayw, patient E) genes PreS1, PreS2, PreC, C, X and polymerase |
| X65259.1 GI:59439 |
| X04615 - SEQ ID NO: 507 |
| Hepatitis B virus genome, subtype ayr |
| X04615.1 GI:59585 |
| D00329 - SEQ ID NO: 508 |
| Hepatitis B virus subtype ADW genomic DNA, complete genome, clone: pJDW233 |
| D00329.1 GI:221497 |
| M32138 - SEQ ID NO: 509 |

TABLE 7-continued

| HBV Accession Numbers |
|---|
| Hepatitis B virus variant HBV-alpha1, complete genome |
| M32138.1 GI:329667 |
| X75657 - SEQ ID NO: 510 |
| Human hepatitis virus (genotype E, Bas) preS1, preS2, S, C, X, antigens, core antigen, X protein and polymerase |
| X75657.1 GI:452617 |
| M12906 - SEQ ID NO: 511 |
| Hepatitis B virus subtype adr, complete genome. |
| M12906.1 GI:474959 |
| X85254 - SEQ ID NO: 512 |
| Hepatitis B virus genome (PreS1, PreS2, S, PreC, C, X genes and polymerase) |
| X85254.1 GI:736003 |
| X51970 - SEQ ID NO: 513 |
| Hepatitis B virus (HBV 991) complete genome. |
| X51970.1 GI:1155012 |
| AB014381 - SEQ ID NO: 514 |
| Hepatitis B virus genomic DNA, complete sequence, isolate 22Y04HCC |
| AB014381.1 GI:3582357 |
| AF100309 - SEQ ID NO: 515 |
| Hepatitis B virus strain 56, complete genome |
| AF100309.1 GI:4323201 |
| AF090842 - SEQ ID NO: 516 |
| Hepatitis B virus strain G5.27295, complete genome |
| AF090842.1 GI:5114084 |
| AB033554 - SEQ ID NO: 517 |
| Hepatitis B virus DNA, complete genome, isolate: RTB299 |
| AB033554.1 GI:6063442 |
| AB032431 - SEQ ID NO: 518 |

TABLE 7-continued

HBV Accession Numbers

Hepatitis B virus genomic DNA, complete sequence, isolate: HBV/E-Ch195
AB032431.1 GI:6691492
AF160501 - SEQ ID NO: 519
Hepatitis B virus strain IG29227, complete genome
AF160501.1 GI:6983934
AB036910 - SEQ ID NO: 520
Hepatitis B virus (genotype F) genomic DNA, complete genome, isolate: VNZ8251
AB036910.1 GI:11191875
AF223965 - SEQ ID NO: 521
Hepatitis B virus strain C-1858 isolate sa16, complete genome
AF223965.1 GI:12247041
AB064310 - SEQ ID NO: 522
Hepatitis B virus DNA, complete genome, clone: USG769
AB064310.1 GI:18146661
AF405706 - SEQ ID NO: 523
Hepatitis B virus isolate 235/01, complete genome
AF405706.1 GI:19849032
AY090454 - SEQ ID NO: 524
Hepatitis B virus strain 1853Nic, complete genome
AY090454.1 GI:22135696
AY090457 - SEQ ID NO: 525
Hepatitis B virus strain 2928Nic, complete genome
AY090457.1 GI:22135711
AY090460 - SEQ ID NO: 526
Hepatitis B virus strain LAS2523, complete genome
AY090460.1 GI:22135726

TABLE 8

Non-limiting examples of Stabilization Chemistries for chemically modified siNA constructs

| Chemistry | pyrimidine | purine | caps | p = S | Strand |
|---|---|---|---|---|---|
| "Stab 00" | Ribo | Ribo | TT at 3'-ends | | S/AS |
| "Stab 1" | Ribo | Ribo | — | 5 at 5'-end 1 at 3'-end | S/AS |
| "Stab 2" | Ribo | Ribo | — | All linkages | Usually AS |
| "Stab 3" | 2'-fluoro | Ribo | — | 4 at 5'-end 4 at 3'-end | Usually S |
| "Stab 4" | 2'-fluoro | Ribo | 5' and 3'-ends | — | Usually S |
| "Stab 5" | 2'-fluoro | Ribo | — | 1 at 3'-end | Usually AS |
| "Stab 6" | 2'-O-Methyl | Ribo | 5' and 3'-ends | — | Usually S |
| "Stab 7" | 2'-fluoro | 2'-deoxy | 5' and 3'-ends | — | Usually S |
| "Stab 8" | 2'-fluoro | 2'-O-Methyl | — | 1 at 3'-end | S/AS |
| "Stab 9" | Ribo | Ribo | 5' and 3'-ends | — | Usually S |
| "Stab 10" | Ribo | Ribo | — | 1 at 3'-end | Usually AS |
| "Stab 11" | 2'-fluoro | 2'-deoxy | — | 1 at 3'-end | Usually AS |
| "Stab 12" | 2'-fluoro | LNA | 5' and 3'-ends | | Usually S |
| "Stab 13" | 2'-fluoro | LNA | | 1 at 3'-end | Usually AS |
| "Stab 14" | 2'-fluoro | 2'-deoxy | | 2 at 5'-end 1 at 3'-end | Usually AS |
| "Stab 15" | 2'-deoxy | 2'-deoxy | | 2 at 5'-end 1 at 3'-end | Usually AS |
| "Stab 16" | Ribo | 2'-O-Methyl | 5' and 3'-ends | | Usually S |
| "Stab 17" | 2'-O-Methyl | 2'-O-Methyl | 5' and 3'-ends | | Usually S |
| "Stab 18" | 2'-fluoro | 2'-O-Methyl | 5' and 3'-ends | | Usually S |
| "Stab 19" | 2'-fluoro | 2'-O-Methyl | 3'-end | | S/AS |
| "Stab 20" | 2'-fluoro | 2'-deoxy | 3'-end | | Usually AS |
| "Stab 21" | 2'-fluoro | Ribo | 3'-end | | Usually AS |
| "Stab 22" | Ribo | Ribo | 3'-end | | Usually AS |
| "Stab 23" | 2'-fluoro* | 2'-deoxy* | 5' and 3'-ends | | Usually S |
| "Stab 24" | 2'-fluoro* | 2'-O-Methyl* | | 1 at 3'-end | S/AS |
| "Stab 25" | 2'-fluoro* | 2'-O-Methyl* | — | 1 at 3'-end | S/AS |

TABLE 8-continued

Non-limiting examples of Stabilization Chemistries for chemically modified siNA constructs

| Chemistry | pyrimidine | purine | caps | p = S | Strand |
|---|---|---|---|---|---|
| "Stab 26" | 2'-fluoro* | 2'-O-Methyl* | — | | S/AS |
| "Stab 27" | 2'-fluoro* | 2'-O-Methyl* | 3'-end | | S/AS |
| "Stab 28" | 2'-fluoro* | 2'-O-Methyl* | 3'-end | | S/AS |
| "Stab 29" | 2'-fluoro* | 2'-O-Methyl* | | 1 at 3'-end | S/AS |
| "Stab 30" | 2'-fluoro* | 2'-O-Methyl* | | | S/AS |
| "Stab 31" | 2'-fluoro* | 2'-O-Methyl* | 3'-end | | S/AS |
| "Stab 32" | 2'-fluoro | 2'-O-Methyl | | | S/AS |
| "Stab 33" | 2'-fluoro | 2'-deoxy* | 5' and 3'-ends | — | Usually S |
| "Stab 34" | 2'-fluoro | 2'-O-Methyl* | 5' and 3'-ends | | Usually S |
| "Stab 35" | 2'-fluoro*† | 2'-O-Methyl*† | | | Usually AS |
| "Stab 36" | 2'-fluoro*† | 2'-O-Methyl*† | | | Usually AS |
| "Stab04H" | 2'-fluoro‡ | Ribo‡ | 5' and 3'-ends | 1 at 3'-end | Ususally S |
| "Stab06C" | 2'-O-Methyl‡ | Ribo‡ | 5' and 3'-ends | | Ususally S |
| "Stab07H" | 2'-fluoro‡ | 2'-deoxy‡ | 5' and 3'-ends | 1 at 3'-end | Usually S |
| "Stab07mU" | 2'-fluoro‡ | 2'-deoxy‡ | 5' and 3'-ends | | Usually S |
| "Stab09H" | Ribo‡ | Ribo‡ | 5' and 3'-ends | 1 at 3'-end | Ususally S |
| "Stab16C" | Ribo‡ | 2'-O-Methyl‡ | 5' and 3'-ends | | Usually S |
| "Stab16H" | Ribo‡ | 2'-O-Methyl‡ | 5' and 3'-ends | 1 at 3'-end | Usually S |
| "Stab18C" | 2'-fluoro‡ | 2'-O-Methyl‡ | 5' and 3'-ends | | Usually S |
| "Stab18H" | 2'-fluoro‡ | 2'-O-Methyl‡ | 5' and 3'-ends | 1 at 3'-end | Usually S |
| "Stab52H" | 2'-O-Methyl‡ | Ribo‡ | 5' and 3'-ends | 1 at 3'-end | Usually S |
| "Stab05C" | 2'-fluoro‡ | Ribo‡ | | | Ususally AS |
| "Stab05N" | 2'-fluoro‡ | Ribo‡ | | 1 at 3'-end | Ususally AS |
| "Stab10C'" | Ribo‡ | Ribo‡ | | | Ususally AS |
| "Stab10N" | Ribo‡ | Ribo‡ | | 1 at 3'-end | Ususally AS |
| "Stab35G*" | 2'-fluoro‡ | 2'-O-Methyl‡ | | | Ususally AS |
| "Stab35N*" | 2'-fluoro‡ | 2'-O-Methyl‡ | | 1 at 3'-end | Ususally AS |
| "Stab35rev*" | 2'-O-Methyl‡ | 2'-fluoro‡ | | | Ususally AS |
| "Stab50*" | Ribo‡ | 2'-O-Methyl‡ | | | Ususally AS |
| "Stab53*" | 2'-O-Methyl‡ | Ribo‡ | | | Ususally AS |
| "Stab53N*" | 2'-O-Methyl‡ | Ribo‡ | | 1 at 3'-end | Ususally AS |
| Stab54 | Ribo‡ | 2'-fluoro‡ | | | Ususally AS |

CAP = any terminal cap, see for example FIG. 6.
All Stab chemistries can be used in combination with each other for duplexes of the invention (e.g., as combinations of sense and antisense strand chemistries), or alternately can be used in isolation, e.g., for single stranded nucleic acid molecules of the invention.
All Stab chemistries can comprise 3'-overhang nucleotides having 2'-O-alkyl, 2'-deoxy-2'-fluoro, 2'-deoxy, LNA or other modified nucleotides or non-nucleotides.
All Stab chemistries typically comprise about 19-21 nucleotides, but can vary as described herein.
All Stab chemistries can also include a single ribonucleotide in the sense or passenger strand at the 11$^{th}$ base paired position of the double-stranded nucleic acid duplex as determined from the 5'-end of the antisense or guide strand.
All Stab chemistries can also have in place of the Stab designation above a 2'-deoxy-2'-fluoro modification at position 14 from the 5' end of the antisense strand regardless of whether it is a purine or pyrimidine at that position.
All Stab chemistries of the antisense strand presented above can have a thymidine in place of a 2'-deoxy uridine at position 1, 2, and/or 3 from the 5' end of the antisense strand.
S = sense strand.
AS = antisense strand
*Stab 23 has a single ribonucleotide adjacent to 3'-CAP.

TABLE 8-continued

Non-limiting examples of Stabilization Chemistries
for chemically modified siNA constructs

| Chemistry | pyrimidine | purine | caps | p = S | Strand |
|---|---|---|---|---|---|

*Stab 24 and Stab 28 have a single ribonucleotide at 5'-terminus.
*Stab 25, Stab 26, Stab 27, Stab 35, Stab 35G*, Stab 35N*, Stab 35rev*, Stab 36, Stab 50*, Stab53*, Stab 53N*, and Stab 54 have three ribonucleotides at 5'-terminus.
*Stab 29, Stab 30, Stab 31, Stab 33, and Stab 34 any purine at first three nucleotide positions from 5'-terminus are ribonucleotides.
p = phosphorothioate linkage.
†Stab 35 has 2'-O-methyl U at 3'-overhangs and three ribonucleotides at 5'-terminus.
†Stab 36 has 2'-O-methyl overhangs that are complementary to the target sequence, (naturally occurring overhangs) and three ribonucleotides at 5'-terminus.
‡Stab 04H, Stab 06C, Stabl07H, Stab07mU, Stab09H, Stab16C, Stab 16H, Stab18C, Stab 18H, Stab 52H, Stab 05C, Stab05N, Stabl0C, Stab10N, Stab35G*, Stab35N*, Stab35rev*, Stab 50*, Stab 53*, Stab 53N*, Stab 54 have two 2'-O-methyl U 3'-overhangs.
Stab35G*, Stab 35N*, Stab35rev*, Stab50*, Stab53*, and Stab53N* do not allow for a 2'-O-methyl modification at position 14 of the guide strand as determined from the 5'-end.

TABLE 9

| Reagent | Equivalents | Amount | Wait Time* DNA | Wait Time* 2'-O-methyl | Wait Time* RNA |
|---|---|---|---|---|---|
| A. 2.5 μmol Synthesis Cycle ABI 394 Instrument | | | | | |
| Phosphoramidites | 6.5 | 163 μL | 45 sec | 2.5 min | 7.5 min |
| S-Ethyl Tetrazole | 23.8 | 238 μL | 45 sec | 2.5 min | 7.5 min |
| Acetic Anhydride | 100 | 233 μL | 5 sec | 5 sec | 5 sec |
| N-HBVhyl Imidazole | 186 | 233 μL | 5 sec | 5 sec | 5 sec |
| TCA | 176 | 2.3 mL | 21 sec | 21 sec | 21 sec |
| Iodine | 11.2 | 1.7 mL | 45 sec | 45 sec | 45 sec |
| Beaucage | 12.9 | 645 μL | 100 sec | 300 sec | 300 sec |
| Acetonitrile | NA | 6.67 mL | NA | NA | NA |
| B. 0.2 μmol Synthesis Cycle ABI 394 Instrument | | | | | |
| Phosphoramidites | 15 | 31 μL | 45 sec | 233 sec | 465 sec |
| S-Ethyl Tetrazole | 38.7 | 31 μL | 45 sec | 233 min | 465 sec |
| Acetic Anhydride | 655 | 124 μL | 5 sec | 5 sec | 5 sec |
| N-HBVhyl Imidazole | 1245 | 124 μL | 5 sec | 5 sec | 5 sec |
| TCA | 700 | 732 μL | 10 sec | 10 sec | 10 sec |
| Iodine | 20.6 | 244 μL | 15 sec | 15 sec | 15 sec |
| Beaucage | 7.7 | 232 μL | 100 sec | 300 sec | 300 sec |
| Acetonitrile | NA | 2.64 mL | NA | NA | NA |
| C. 0.2 μmol Synthesis Cycle 96 well Instrument | | | | | |

| Reagent | Equivalents: DNA/2'-O-methyl/Ribo | Amount: DNA/2'-O-methyl/Ribo | Wait Time* DNA | Wait Time* 2'-O-methyl | Wait Time* Ribo |
|---|---|---|---|---|---|
| Phosphoramidites | 22/33/66 | 40/60/120 μL | 60 sec | 180 sec | 360 sec |
| S-Ethyl Tetrazole | 70/105/210 | 40/60/120 μL | 60 sec | 180 min | 360 sec |
| Acetic Anhydride | 265/265/265 | 50/50/50 μL | 10 sec | 10 sec | 10 sec |
| N-HBVhyl Imidazole | 502/502/502 | 50/50/50 μL | 10 sec | 10 sec | 10 sec |
| TCA | 238/475/475 | 250/500/500 μL | 15 sec | 15 sec | 15 sec |
| Iodine | 6.8/6.8/6.8 | 80/80/80 μL | 30 sec | 30 sec | 30 sec |
| Beaucage | 34/51/51 | 80/120/120 | 100 sec | 200 sec | 200 sec |
| Acetonitrile | NA | 1150/1150/1150 μL | NA | NA | NA |

Wait time does not include contact time during delivery.
Tandem synthesis utilizes double coupling of linker molecule

TABLE 10

Composition of Select Lipid Nanoparticle Formulations

| LNP Identifier | Lipid Components and Molar Ratios | | | | siNA Duplex | N/P |
|---|---|---|---|---|---|---|
| LNP-1 | Compound 32 (50%) | Cholesterol (30%) | DSPC (10%) | PEG-DMG (2%) | R-008380648-000E | 6 |
| LNP-2 | Compound 32 (50%) | Cholesterol (30%) | DSPC (10%) | PEG-DMG (2%) | R-008380783-000R | 6 |

TABLE 10-continued

Composition of Select Lipid Nanoparticle Formulations

| LNP Identifier | Lipid Components and Molar Ratios | | | | siNA Duplex | N/P |
|---|---|---|---|---|---|---|
| LNP-3 | Compound 32 (50%) | Cholesterol (30%) | DSPC (10%) | PEG-DMG (2%) | R-008380665-000N | 6 |
| LNP-4 | Compound 32 (50%) | Cholesterol (30%) | DSPC (10%) | PEG-DMG (2%) | R-008380645-000D | 6 |
| LNP-5 | Compound 32 (50%) | Cholesterol (30%) | DSPC (10%) | PEG-DMG (2%) | R-008380408-000R | 6 |
| LNP-6 | Compound 32 (50%) | Cholesterol (30%) | DSPC (10%) | PEG-DMG (2%) | R-008380633-000U | 6 |
| LNP-7 | Compound 32 (50%) | Cholesterol (30%) | DSPC (10%) | PEG-DMG (2%) | R-008380767-000R | 6 |
| LNP-8 | Compound 32 (50%) | Cholesterol (30%) | DSPC (10%) | PEG-DMG (2%) | R-008380730-000C | 6 |
| LNP-9 | Compound 32 (50%) | Cholesterol (30%) | DSPC (10%) | PEG-DMG (2%) | R-008380777-000H | 6 |
| LNP-10 | Compound 32 (50%) | Cholesterol (30%) | DSPC (10%) | PEG-DMG (2%) | R-008380740-000V | 6 |
| LNP-11 | Compound 32 (50%) | Cholesterol (30%) | DSPC (10%) | PEG-DMG (2%) | R-008380558-000M | 6 |
| LNP-12 | Compound 32 (50%)6 | Cholesterol (30%) | DSPC (10%) | PEG-DMG (2%) | R-008380406-000Y | 6 |
| LNP-13 | Compou6nd 32 (50%) | Cholesterol (30%) | DSPC (10%) | PEG-DMG (2%) | R-008380764-000P | 6 |
| LNP-14 | Compound 32 (50%) | Cholesterol (30%) | DSPC (10%) | PEG-DMG (2%) | R-008380772-000P | 6 |
| LNP-15 | Compound 32 (50%) | Cholesterol (30%) | DSPC (10%) | PEG-DMG (2%) | R-008380389-000D | 6 |
| LNP-16 | Compound 32 (50%) | Cholesterol (30%) | DSPC (10%) | PEG-DMG (2%) | R-008380362-000H | 6 |
| LNP-17 | Compound 32 (50%) | Cholesterol (30%) | DSPC (10%) | PEG-DMG (2%) | R-008380363-000S | 6 |
| LNP-18 | Compound 32 (50%) | Cholesterol (30%) | DSPC (10%) | PEG-DMG (2%) | R-008380340-000F | 6 |
| LNP-19 | Compound 32 (50%) | Cholesterol (30%) | DSPC (10%) | PEG-DMG (2%) | R-008380689-000H | 6 |
| LNP-20 | Compound 32 (50%) | Cholesterol (30%) | DSPC (10%) | PEG-DMG (2%) | R-008380756-000P | 6 |
| LNP-21 | Compound 32 (50%) | Cholesterol (30%) | DSPC (10%) | PEG-DMG (2%) | R-008380736-000E | 6 |
| LNP-22 | Compound 32 (50%) | Cholesterol (30%) | DSPC (10%) | PEG-DMG (2%) | R-008380757-000Y | 6 |
| LNP-23 | Compound 32 (50%) | Cholesterol (30%) | DSPC (10%) | PEG-DMG (2%) | R-008380753-000N | 6 |
| LNP-24 | Compound 32 (50%) | Cholesterol (30%) | DSPC (10%) | PEG-DMG (2%) | R-008380737-000N | 6 |
| LNP-25 | Compound 32 (50%) | Cholesterol (30%) | DSPC (10%) | PEG-DMG (2%) | R-008380734-000M | 6 |
| LNP-26 | Compound 32 (50%) | Cholesterol (30%) | DSPC (10%) | PEG-DMG (2%) | R-008380791-000R | 6 |

N/P ratio = Nitrogen:Phosphorous ratio between cationic lipid and nucleic acid

TABLE 11

Chemical Structures of Lipids in Formulations of Table 10

| Lipid | Chemical Structure |
|---|---|
| Compound 32 | [chemical structure: tertiary dimethylamino group attached to a branched lipid with a long unsaturated hydrocarbon chain containing two double bonds and a saturated alkyl branch] |

TABLE 11-continued

Chemical Structures of Lipids in Formulations of Table 10

| Lipid | Chemical Structure |
|---|---|
| Cholesterol | 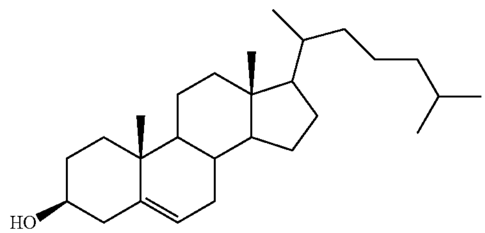 [SMILES: CC(C)CCCC(C)C1CCC2C3CC=C4C[C@@H](O)CC[C@]4(C)C3CC[C@]12C] |
| DSPC | 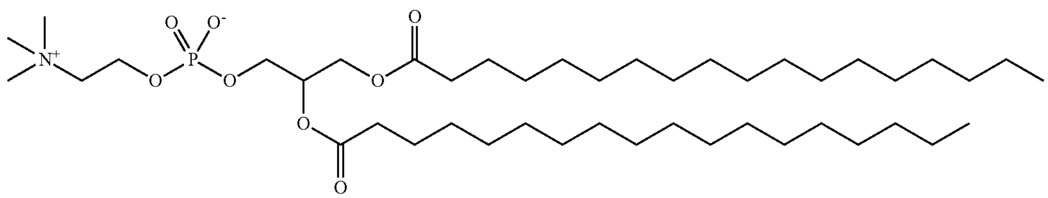 [SMILES: CCCCCCCCCCCCCCCCCC(=O)OCC(COP(=O)([O-])OCC[N+](C)(C)C)OC(=O)CCCCCCCCCCCCCCCCC] |
| PEG-DMG | 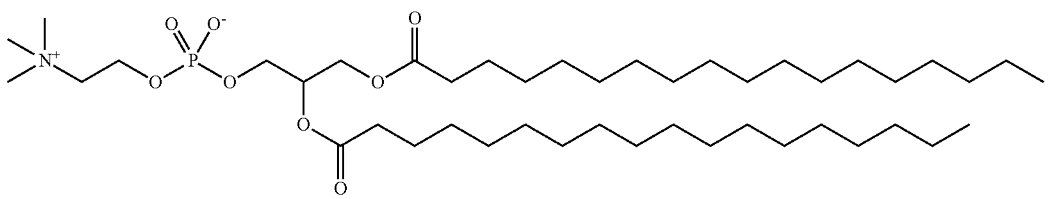 [SMILES: CCCCCCCCCCCCCCCCCC(=O)OCC(COP(=O)([O-])OCC[N+](C)(C)C)OC(=O)CCCCCCCCCCCCCCCCC] |

SEQUENCE LISTING (526 sequences)

SEQ ID NO: 1 - RNA, 19 nt, Artificial Sequence
  Synthetic
ucgugguggacuucucuca

SEQ ID NO: 2 - RNA, 19 nt, Artificial Sequence
  Synthetic
gugguggacuucucucaau

SEQ ID NO: 3 - RNA, 19 nt, Artificial Sequence
  Synthetic
gccgauccauacugcggaa

SEQ ID NO: 4 - RNA, 19 nt, Artificial Sequence
  Synthetic
ccgauccauacugcggaac

SEQ ID NO: 5 - RNA, 19 nt, Artificial Sequence
  Synthetic
cauccugcugcuaugccuc

SEQ ID NO: 6 - RNA, 19 nt, Artificial Sequence
  Synthetic
ugcugcuaugccucaucuu

SEQ ID NO: 7 - RNA, 19 nt, Artificial Sequence
  Synthetic
gguggacuucucucaauuu

SEQ ID NO: 8 - RNA, 19 nt, Artificial Sequence
  Synthetic
ugguggacuucucucaauu

SEQ ID NO: 9 - RNA, 19 nt, Artificial Sequence
  Synthetic
uagacucgugguggacuuc

SEQ ID NO: 10 - RNA, 19 nt, Artificial Sequence
  Synthetic
uccucugccgauccauacu

SEQ ID NO: 11 - RNA, 19 nt, Artificial Sequence
  Synthetic
ugccgauccauacugcgga

SEQ ID NO: 12 - RNA, 19 nt, Artificial Sequence
  Synthetic
uggaugugucugcggcguu

SEQ ID NO: 13 - RNA, 19 nt, Artificial Sequence
  Synthetic
cgauccauacugcggaacu

SEQ ID NO: 14 - RNA, 19 nt, Artificial Sequence
  Synthetic
cgcaccucucuuuacgcgg

SEQ ID NO: 15 - RNA, 19 nt, Artificial Sequence
  Synthetic
cugccgauccauacugcgg

SEQ ID NO: 16 - RNA, 19 nt, Artificial Sequence
  Synthetic
cgugguggacuucucucaa

SEQ ID NO: 17 - RNA, 19 nt, Artificial Sequence
  Synthetic
cugcugcuaugccucaucu

SEQ ID NO: 18 - RNA, 19 nt, Artificial Sequence
  Synthetic
ccugcugcuaugccucauc

SEQ ID NO: 19 - RNA, 19 nt, Artificial Sequence
  Synthetic
cuagacucgugguggacuu

SEQ ID NO: 20 - RNA, 19 nt, Artificial Sequence
  Synthetic
uccugcugcuaugccucau

SEQ ID NO: 21 - RNA, 19 nt, Artificial Sequence
  Synthetic
gacucgugguggacuucuc

SEQ ID NO: 22 - RNA, 19 nt, Artificial Sequence
  Synthetic
auccauacugcggaacucc

SEQ ID NO: 23 - RNA, 19 nt, Artificial Sequence
  Synthetic
cucugccgauccauacugc

SEQ ID NO: 24 - RNA, 19 nt, Artificial Sequence
  Synthetic
gauccauacugcggaacuc

SEQ ID NO: 25 - RNA, 19 nt, Artificial Sequence
  Synthetic
gaagaacucccucgccucg

SEQ ID NO: 26 - RNA, 19 nt, Artificial Sequence
  Synthetic
aagccuccaagcugugccu

SEQ ID NO: 27 - RNA, 19 nt, Artificial Sequence
  Synthetic
agaagaacucccucgccuc

SEQ ID NO: 28 - RNA, 19 nt, Artificial Sequence
  Synthetic
ggaguguggauucgcacuc

SEQ ID NO: 29 - RNA, 19 nt, Artificial Sequence
  Synthetic
ccucugccgauccauacug

SEQ ID NO: 30 - RNA, 19 nt, Artificial Sequence
  Synthetic
caagccuccaagcugugcc

SEQ ID NO: 31 - RNA, 19 nt, Artificial Sequence
  Synthetic
uccauacugcggaacuccu

SEQ ID NO: 32 - RNA, 19 nt, Artificial Sequence
  Synthetic
cagagucuagacucguggu

SEQ ID NO: 33 - RNA, 19 nt, Artificial Sequence
  Synthetic
aagaagaacucccucgccu

SEQ ID NO: 34 - RNA, 19 nt, Artificial Sequence
  Synthetic
gaguguggauucgcacucc

SEQ ID NO: 35 - RNA, 19 nt, Artificial Sequence
  Synthetic
ucuagacucgugguggacu

SEQ ID NO: 36 - RNA, 19 nt, Artificial Sequence
  Synthetic
gcugcuaugccucaucuuc

SEQ ID NO: 37 - RNA, 19 nt, Artificial Sequence
  Synthetic
agucuagacucguggugga

SEQ ID NO: 38 - RNA, 19 nt, Artificial Sequence
  Synthetic
cuccucugccgauccauac

SEQ ID NO: 39 - RNA, 19 nt, Artificial Sequence
  Synthetic
uggcucaguuuacuagugc

SEQ ID NO: 40 - RNA, 19 nt, Artificial Sequence
  Synthetic
gucuagacucgugguggac

SEQ ID NO: 41 - RNA, 19 nt, Artificial Sequence
  Synthetic
uucaagccuccaagcugug

SEQ ID NO: 42 - RNA, 19 nt, Artificial Sequence
  Synthetic
cuaugggagugggccucag

SEQ ID NO: 43 - RNA, 19 nt, Artificial Sequence
  Synthetic
cucgugguggacuucucuc

SEQ ID NO: 44 - RNA, 19 nt, Artificial Sequence
  Synthetic
ccuaugggagugggccuca

SEQ ID NO: 45 - RNA, 19 nt, Artificial Sequence
  Synthetic
aagaacucccucgccucgc

SEQ ID NO: 46 - RNA, 19 nt, Artificial Sequence
  Synthetic
ucugccgauccauacugcg

SEQ ID NO: 47 - RNA, 19 nt, Artificial Sequence
  Synthetic
agagucuagacucguggug

SEQ ID NO: 48 - RNA, 19 nt, Artificial Sequence
  Synthetic
gaagaagaacucccucgcc

SEQ ID NO: 49 - RNA, 19 nt, Artificial Sequence
  Synthetic
ucaagccuccaagcugugc

SEQ ID NO: 50 - RNA, 19 nt, Artificial Sequence
  Synthetic
agccuccaagcugugccuu

SEQ ID NO: 51 - RNA, 19 nt, Artificial Sequence
  Synthetic
agacucgugguggacuucu

SEQ ID NO: 52 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucgugguggacuucucucatt

SEQ ID NO: 53 - RNA, 21 nt, Artificial Sequence
  Synthetic
  misc_feature (20)..(21): 2'-O-methyl
ugagagaaguccaccacgauu

SEQ ID NO: 54 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(4): 2'-deoxy
  misc_feature (5)..(5): 2'-deoxy-2'-fluoro
  misc_feature (6)..(8): 2'-deoxy
  misc_feature (9)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
gugguggacuucucucaautt

SEQ ID NO: 55 - RNA, 21 nt, Artificial Sequence
  Synthetic
  misc_feature (4)..(11): 2'-O-methyl
  misc_feature (12)..(14): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
auugagagaaguccaccacuu

SEQ ID NO: 56 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gccgauccauacugcggaatt

SEQ ID NO: 57 - RNA, 21 nt, Artificial Sequence
  Synthetic
  misc_feature (20)..(21): 2'-O-methyl
uuccgcaguauggaucggcuu

SEQ ID NO: 58 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugguggacuucucucaautt

SEQ ID NO: 59 - RNA, 21 nt, Artificial Sequence
  Synthetic
  misc_feature (20)..(21): 2'-O-methyl
auugagagaaguccaccacuu

SEQ ID NO: 60 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(4): 2'-deoxy
  misc_feature (5)..(7): 2'-deoxy-2'-fluoro
  misc_feature (8)..(8): 2'-deoxy
  misc_feature (9)..(9): 2'-deoxy-2'-fluoro
  misc_feature (10)..(10): 2'-deoxy
  misc_feature (11)..(12): 2'-deoxy-2'-fluoro
  misc_feature (13)..(13): 2'-deoxy
  misc_feature (14)..(14): 2'-deoxy-2'-fluoro
  misc_feature (15)..(18): 2'-deoxy
  misc_feature (19)..(19): 2'-deoxy-2'-fluoro
  misc_feature (21)..(21): inverted abasic cap
ccgauccauacugcggaactt

SEQ ID NO: 61 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(9): 2'-O-methyl
  misc_feature (10)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (15)..(15): 2'-O-methyl
  misc_feature (16)..(17): 2'-deoxy-2'-fluoro
  misc_feature (18)..(21): 2'-O-methyl
guuccgcaguauggaucgguu

SEQ ID NO: 62 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cauccugcugcuaugccuctt

SEQ ID NO: 63 - RNA, 21 nt, Artificial Sequence
  Synthetic
  misc_feature (20)..(21): 2'-O-methyl
gaggcauagcagcaggauguu

SEQ ID NO: 64 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcugcuaugccucaucuutt

SEQ ID NO: 65 - RNA, 21 nt, Artificial Sequence
  Synthetic
  misc_feature (20)..(21): 2'-O-methyl
aagaugaggcauagcagcauu

SEQ ID NO: 66 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(3): 2'-deoxy-2'-fluoro
  misc_feature (4)..(6): 2'-deoxy
  misc_feature (7)..(14): 2'-deoxy-2'-fluoro
  misc_feature (15)..(16): 2'-deoxy
  misc_feature (17)..(19): 2'-deoxy-2'-fluoro
  misc_feature (21)..(21): inverted abasic cap
gguggacuucucucaauuutt

SEQ ID NO: 67 - RNA, 21 nt, Artificial Sequence
  Synthetic
  misc_feature (4)..(5): 2'-deoxy-2'-fluoro
  misc_feature (6)..(13): 2'-O-methyl
  misc_feature (14)..(16): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
aaauugagagaaguccaccuu

SEQ ID NO: 68 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(3): 2'-deoxy
  misc_feature (4)..(4): 2'-deoxy-2'-fluoro
  misc_feature (5)..(7): 2'-deoxy
  misc_feature (8)..(15): 2'-deoxy-2'-fluoro
  misc_feature (16)..(17): 2'-deoxy
  misc_feature (18)..(19): 2'-deoxy-2'-fluoro
  misc_feature (21)..(21): inverted abasic cap
ugguggacuucucucaauutt

SEQ ID NO: 69 - RNA, 21 nt, Artificial Sequence
  Synthetic
  misc_feature (4)..(4): 2'-deoxy-2'-fluoro
  misc_feature (5)..(12): 2'-O-methyl
  misc_feature (13)..(15): 2'-deoxy-2'-fluoro
  misc_feature (16)..(16): 2'-O-methyl
  misc_feature (17)..(18): 2'-deoxy-2'-fluoro
  misc_feature (19)..(21): 2'-O-methyl
aauugagagaaguccaccauu

SEQ ID NO: 70 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uagacucgugguggacuuctt

SEQ ID NO: 71 - RNA, 21 nt, Artificial Sequence
  Synthetic
  misc_feature (20)..(21): 2'-O-methyl
gaaguccaccacgagucuauu

SEQ ID NO: 72 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccucugccgauccauacutt

SEQ ID NO: 73 - RNA, 21 nt, Artificial Sequence
  Synthetic
  misc_feature (20)..(21): 2'-O-methyl
aguauggaucggcagaggauu

SEQ ID NO: 74 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(7): 2'-deoxy-2'-fluoro
  misc_feature (8)..(8): 2'-deoxy
  misc_feature (9)..(9): 2'-deoxy-2'-fluoro
  misc_feature (10)..(11): 2'-deoxy
  misc_feature (12)..(12): 2'-deoxy-2'-fluoro
  misc_feature (13)..(15): 2'-deoxy
  misc_feature (16)..(19): 2'-deoxy-2'-fluoro
  misc_feature (21)..(21): inverted abasic cap
uagacucgugguggacuuctt

SEQ ID NO: 75 - RNA, 21 nt, Artificial Sequence
  Synthetic
  misc_feature (4)..(4): 2'-O-methyl
  misc_feature (5)..(7): 2'-deoxy-2'-fluoro
  misc_feature (8)..(8): 2'-O-methyl
  misc_feature (9)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (15)..(15): 2'-O-methyl
  misc_feature (16)..(18): 2'-deoxy-2'-fluoro
  misc_feature (19)..(21): 2'-O-methyl
gaaguccaccacgagucuauu

SEQ ID NO: 76 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugccgauccauacugcggatt

SEQ ID NO: 77 - RNA, 21 nt, Artificial Sequence
  Synthetic
  misc_feature (20)..(21): 2'-O-methyl
uccgcaguauggaucggcauu

SEQ ID NO: 78 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggaugugucugcggcguutt

SEQ ID NO: 79 - RNA, 21 nt, Artificial Sequence
  Synthetic
  misc_feature (20)..(21): 2'-O-methyl
aacgccgcagacacauccauu

SEQ ID NO: 80 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgauccauacugcggaacutt

SEQ ID NO: 81 - RNA, 21 nt, Artificial Sequence
  Synthetic
  misc_feature (20)..(21): 2'-O-methyl
aguuccgcaguauggaucguu

SEQ ID NO: 82 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgcaccucucuuuacgcggtt

SEQ ID NO: 83 - RNA, 21 nt, Artificial Sequence
  Synthetic
  misc_feature (20)..(21): 2'-O-methyl
ccgcguaaagagaggugcguu

SEQ ID NO: 84 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugccgauccauacugcggtt

SEQ ID NO: 85 - RNA, 21 nt, Artificial Sequence
  Synthetic
  misc_feature (20)..(21): 2'-O-methyl
ccgcaguauggaucggcaguu

SEQ ID NO: 86 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (8)..(8): 2'-deoxy
  misc_feature (9)..(11): 2'-deoxy-2'-fluoro
  misc_feature (12)..(12): 2'-deoxy
  misc_feature (13)..(13): 2'-deoxy-2'-fluoro
  misc_feature (14)..(15): 2'-deoxy
  misc_feature (16)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
uggaugugucugcggcguutt

SEQ ID NO: 87 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(7): 2'-O-methyl
  misc_feature (8)..(8): 2'-deoxy-2'-fluoro
  misc_feature (9)..(11): 2'-O-methyl
  misc_feature (12)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(18): 2'-deoxy-2'-fluoro
  misc_feature (19)..(21): 2'-O-methyl
aacgccgcagacacauccauu

SEQ ID NO: 88 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugguggacuucucucaauutt

SEQ ID NO: 89 - RNA, 21 nt, Artificial Sequence
  Synthetic
  misc_feature (20)..(21): 2'-O-methyl
aauugagagaaguccaccauu

SEQ ID NO: 90 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgugguggacuucucucaatt

SEQ ID NO: 91 - RNA, 21 nt, Artificial Sequence
  Synthetic
  misc_feature (20)..(21): 2'-O-methyl
uugagagaaguccaccacguu

SEQ ID NO: 92 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugcugcuaugccucaucutt

SEQ ID NO: 93 - RNA, 21 nt, Artificial Sequence
  Synthetic
  misc_feature (20)..(21): 2'-O-methyl
agaugaggcauagcagcaguu

SEQ ID NO: 94 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccugcugcuaugccucauctt

SEQ ID NO: 95 - RNA, 21 nt, Artificial Sequence
  Synthetic
  misc_feature (20)..(21): 2'-O-methyl
gaugaggcauagcagcagguu

SEQ ID NO: 96 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gguggacuucucucaauuutt

SEQ ID NO: 97 - RNA, 21 nt, Artificial Sequence
  Synthetic
  misc_feature (20)..(21): 2'-O-methyl
aaauugagagaaguccaccuu

SEQ ID NO: 98 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(5): 2'-deoxy
  misc_feature (6)..(8): 2'-deoxy-2'-fluoro
  misc_feature (9)..(9): 2'-deoxy
  misc_feature (10)..(10): 2'-deoxy-2'-fluoro
  misc_feature (11)..(12): 2'-deoxy
  misc_feature (13)..(13): 2'-deoxy-2'-fluoro
  misc_feature (14)..(16): 2'-deoxy
  misc_feature (17)..(19): 2'-deoxy-2'-fluoro
  misc_feature (21)..(21): inverted abasic cap
cuagacucgugguggacuutt

SEQ ID NO: 99 - RNA, 21 nt, Artificial Sequence
  Synthetic
  misc_feature (4)..(6): 2'-deoxy-2'-fluoro
  misc_feature (7)..(7): 2'-O-methyl
  misc_feature (8)..(9): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (15)..(17): 2'-deoxy-2'-fluoro
  misc_feature (18)..(21): 2'-O-methyl
aaguccaccacgagucuaguu

SEQ ID NO: 100 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccugcugcuaugccucautt

SEQ ID NO: 101 - RNA, 21 nt, Artificial Sequence
  Synthetic
  misc_feature (20)..(21): 2'-O-methyl
augaggcauagcagcaggauu

SEQ ID NO: 102 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(6): 2'-deoxy
  misc_feature (7)..(9): 2'-deoxy-2'-fluoro
  misc_feature (10)..(10): 2'-deoxy
  misc_feature (11)..(11): 2'-deoxy-2'-fluoro
  misc_feature (12)..(12): 2'-deoxy
  misc_feature (13)..(14): 2'-deoxy-2'-fluoro
  misc_feature (15)..(15): 2'-deoxy
  misc_feature (16)..(16): 2'-deoxy-2'-fluoro
  misc_feature (17)..(19): 2'-deoxy
  misc_feature (21)..(21): inverted abasic cap
ugccgauccauacugcggatt

SEQ ID NO: 103 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(7): 2'-O-methyl
  misc_feature (8)..(8): 2'-deoxy-2'-fluoro
  misc_feature (9)..(9): 2'-O-methyl
  misc_feature (10)..(10): 2'-deoxy-2'-fluoro
  misc_feature (11)..(13): 2'-O-methyl
  misc_feature (14)..(15): 2'-deoxy-2'-fluoro
  misc_feature (16)..(17): 2'-O-methyl
  misc_feature (18)..(18): 2'-deoxy-2'-fluoro
  misc_feature (19)..(21): 2'-O-methyl
uccgcaguauggaucggcauu

SEQ ID NO: 104 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuagacucgugguggacuutt

SEQ ID NO: 105 - RNA, 21 nt, Artificial Sequence
  Synthetic
  misc_feature (20)..(21): 2'-O-methyl
aaguccaccacgagucuaguu

SEQ ID NO: 106 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacucgugguggacuucuctt

SEQ ID NO: 107 - RNA, 21 nt, Artificial Sequence
  Synthetic
  misc_feature (20)..(21): 2'-O-methyl
gagaaguccaccacgagucuu

SEQ ID NO: 108 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(4): 2'-deoxy-2'-fluoro
  misc_feature (5)..(5): 2'-deoxy
  misc_feature (6)..(6): 2'-deoxy-2'-fluoro
  misc_feature (7)..(7): 2'-deoxy
  misc_feature (8)..(9): 2'-deoxy-2'-fluoro
  misc_feature (10)..(10): 2'-deoxy
  misc_feature (11)..(11): 2'-deoxy-2'-fluoro
  misc_feature (12)..(15): 2'-deoxy
  misc_feature (16)..(19): 2'-deoxy-2'-fluoro
  misc_feature (21)..(21): inverted abasic cap
auccauacugcggaacucctt

SEQ ID NO: 109 - RNA, 21 nt, Artificial Sequence
  Synthetic
  misc_feature (4)..(4): 2'-O-methyl
  misc_feature (5)..(8): 2'-deoxy-2'-fluoro
  misc_feature (9)..(9): 2'-O-methyl
  misc_feature (10)..(10): 2'-deoxy-2'-fluoro
  misc_feature (11)..(12): 2'-O-methyl
  misc_feature (13)..(13): 2'-deoxy-2'-fluoro
  misc_feature (15)..(15): 2'-deoxy-2'-fluoro
  misc_feature (16)..(18): 2'-O-methyl
  misc_feature (19)..(19): 2'-deoxy-2'-fluoro
  misc_feature (20)..(21): 2'-O-methyl
ggaguuccgcaguauggauuu

SEQ ID NO: 110 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(4): 2'-deoxy-2'-fluoro
  misc_feature (5)..(5): 2'-deoxy
  misc_feature (6)..(7): 2'-deoxy-2'-fluoro
  misc_feature (8)..(9): 2'-deoxy
  misc_feature (10)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
cucugccgauccauacugctt

SEQ ID NO: 111 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(10): 2'-O-methyl
  misc_feature (11)..(12): 2'-deoxy-2'-fluoro
  misc_feature (13)..(13): 2'-O-methyl
  misc_feature (15)..(15): 2'-deoxy-2'-fluoro
  misc_feature (16)..(21): 2'-O-methyl
gcaguauggaucggcagaguu

SEQ ID NO: 112 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauccauacugcggaacuctt

SEQ ID NO: 113 - RNA, 21 nt, Artificial Sequence
  Synthetic
  misc_feature (20)..(21): 2'-O-methyl
gaguuccgcaguauggaucuu

SEQ ID NO: 114 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaagaacucccucgccucgtt

SEQ ID NO: 115 - RNA, 21 nt, Artificial Sequence
  Synthetic
  misc_feature (20)..(21): 2'-O-methyl
cgaggcgagggaguucuucuu

SEQ ID NO: 116 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy
  misc_feature (4)..(8): 2'-deoxy-2'-fluoro
  misc_feature (9)..(11): 2'-deoxy
  misc_feature (12)..(13): 2'-deoxy-2'-fluoro
  misc_feature (14)..(14): 2'-deoxy
  misc_feature (15)..(15): 2'-deoxy-2'-fluoro
  misc_feature (16)..(16): 2'-deoxy
  misc_feature (17)..(19): 2'-deoxy-2'-fluoro
  misc_feature (21)..(21): inverted abasic cap
aagccuccaagcugugccutt

SEQ ID NO: 117 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(8): 2'-O-methyl
  misc_feature (9)..(11): 2'-deoxy-2'-fluoro
  misc_feature (12)..(13): 2'-O-methyl
  misc_feature (15)..(16): 2'-O-methyl
  misc_feature (17)..(19): 2'-deoxy-2'-fluoro
  misc_feature (20)..(21): 2'-O-methyl
aggcacagcuuggaggcuuuu

SEQ ID NO: 118 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaagaacucccucgccuctt

SEQ ID NO: 119 - RNA, 21 nt, Artificial Sequence
  Synthetic
  misc_feature (20)..(21): 2'-O-methyl
gaggcgagggaguucuucuuu

SEQ ID NO: 120 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(3): 2'-deoxy
  misc_feature (4)..(6): 2'-deoxy-2'-fluoro
  misc_feature (7)..(7): 2'-deoxy
  misc_feature (8)..(8): 2'-deoxy-2'-fluoro
  misc_feature (9)..(9): 2'-deoxy
  misc_feature (10)..(11): 2'-deoxy-2'-fluoro
  misc_feature (12)..(12): 2'-deoxy
  misc_feature (13)..(13): 2'-deoxy-2'-fluoro
  misc_feature (14)..(17): 2'-deoxy
  misc_feature (18)..(19): 2'-deoxy-2'-fluoro
  misc_feature (21)..(21): inverted abasic cap
cgauccauacugcggaacutt

SEQ ID NO: 121 - RNA, 21 nt, Artificial Sequence
  Synthetic
  misc_feature (4)..(6): 2'-deoxy-2'-fluoro
  misc_feature (7)..(7): 2'-O-methyl
  misc_feature (8)..(8): 2'-deoxy-2'-fluoro
  misc_feature (9)..(10): 2'-O-methyl
  misc_feature (11)..(11): 2'-deoxy-2'-fluoro
  misc_feature (12)..(12): 2'-O-methyl
  misc_feature (13)..(13): 2'-deoxy-2'-fluoro
  misc_feature (15)..(16): 2'-O-methyl
  misc_feature (17)..(18): 2'-deoxy-2'-fluoro
  misc_feature (19)..(21): 2'-O-methyl
aguuccgcaguauggaucguu

SEQ ID NO: 122 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaguguggauucgcacuctt

SEQ ID NO: 123 - RNA, 21 nt, Artificial Sequence
  Synthetic
  misc_feature (20)..(21): 2'-O-methyl
gagugcgaauccacacuccuu

SEQ ID NO: 124 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(5): 2'-deoxy-2'-fluoro
  misc_feature (6)..(6): 2'-deoxy
  misc_feature (7)..(8): 2'-deoxy-2'-fluoro
  misc_feature (9)..(10): 2'-deoxy
  misc_feature (11)..(13): 2'-deoxy-2'-fluoro
  misc_feature (14)..(14): 2'-deoxy
  misc_feature (15)..(15): 2'-deoxy-2'-fluoro
  misc_feature (16)..(16): 2'-deoxy
  misc_feature (17)..(18): 2'-deoxy-2'-fluoro
  misc_feature (19)..(19): 2'-deoxy
  misc_feature (21)..(21): inverted abasic cap
ccucugccgauccauacugtt

SEQ ID NO: 125 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(9): 2'-O-methyl
  misc_feature (10)..(11): 2'-deoxy-2'-fluoro
  misc_feature (12)..(13): 2'-O-methyl
  misc_feature (14)..(14): 2'-deoxy-2'-fluoro
  misc_feature (15)..(21): 2'-O-methyl
caguauggaucggcagagguu

SEQ ID NO: 126 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(9): 2'-deoxy-2'-fluoro
  misc_feature (10)..(12): 2'-deoxy
  misc_feature (13)..(14): 2'-deoxy-2'-fluoro
  misc_feature (15)..(15): 2'-deoxy
  misc_feature (16)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
caagccuccaagcugugcctt

SEQ ID NO: 127 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(7): 2'-O-methyl
  misc_feature (8)..(10): 2'-deoxy-2'-fluoro
  misc_feature (11)..(13): 2'-O-methyl
  misc_feature (15)..(15): 2'-O-methyl
  misc_feature (16)..(18): 2'-deoxy-2'-fluoro
  misc_feature (19)..(21): 2'-O-methyl
ggcacagcuuggaggcuuguu

SEQ ID NO: 128 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccauacugcggaacuccutt

SEQ ID NO: 129 - RNA, 21 nt, Artificial Sequence
  Synthetic
  misc_feature (20)..(21): 2'-O-methyl
aggaguuccgcaguauggauu

SEQ ID NO: 130 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagagucuagacucguggutt

SEQ ID NO: 131 - RNA, 21 nt, Artificial Sequence
  Synthetic
  misc_feature (20)..(21): 2'-O-methyl
accacgagucuagacucuguu

SEQ ID NO: 132 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(8): 2'-deoxy
  misc_feature (9)..(15): 2'-deoxy-2'-fluoro
  misc_feature (16)..(16): 2'-deoxy
  misc_feature (17)..(19): 2'-deoxy-2'-fluoro
  misc_feature (21)..(21): inverted abasic cap
aagaagaacucccucgccutt

SEQ ID NO: 133 - RNA, 21 nt, Artificial Sequence
  Synthetic
  misc_feature (4)..(4): 2'-deoxy-2'-fluoro
  misc_feature (5)..(11): 2'-O-methyl
  misc_feature (12)..(19): 2'-deoxy-2'-fluoro
  misc_feature (20)..(21): 2'-O-methyl
aggcgagggaguucuucuuuu

SEQ ID NO: 134 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaguguggauucgcacucctt

SEQ ID NO: 135 - RNA, 21 nt, Artificial Sequence
  Synthetic
  misc_feature (20)..(21): 2'-O-methyl
ggagugcgaauccacacucuu

SEQ ID NO: 136 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuagacucgugguggacutt

SEQ ID NO: 137 - RNA, 21 nt, Artificial Sequence
  Synthetic
  misc_feature (20)..(21): 2'-O-methyl
aguccaccacgagucuagauu

SEQ ID NO: 138 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(6): 2'-deoxy-2'-fluoro
  misc_feature (7)..(7): 2'-deoxy
  misc_feature (8)..(9): 2'-deoxy-2'-fluoro
  misc_feature (10)..(11): 2'-deoxy
  misc_feature (12)..(14): 2'-deoxy-2'-fluoro
  misc_feature (15)..(15): 2'-deoxy
  misc_feature (16)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
uccucugccgauccauacutt

SEQ ID NO: 139 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(8): 2'-O-methyl
  misc_feature (9)..(10): 2'-deoxy-2'-fluoro
  misc_feature (11)..(12): 2'-O-methyl
  misc_feature (13)..(13): 2'-deoxy-2'-fluoro
  misc_feature (15)..(21): 2'-O-methyl
aguauggaucggcagaggauu

SEQ ID NO: 140 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caagccuccaagcugugcctt

SEQ ID NO: 141 - RNA, 21 nt, Artificial Sequence
  Synthetic
  misc_feature (20)..(21): 2'-O-methyl
ggcacagcuuggaggcuuguu

SEQ ID NO: 142 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(4): 2'-deoxy
  misc_feature (5)..(6): 2'-deoxy-2'-fluoro
  misc_feature (7)..(7): 2'-deoxy
  misc_feature (8)..(9): 2'-deoxy-2'-fluoro
  misc_feature (10)..(10): 2'-deoxy
  misc_feature (11)..(11): 2'-deoxy-2'-fluoro
  misc_feature (12)..(12): 2'-deoxy
  misc_feature (13)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
ccugcugcuaugccucauctt

SEQ ID NO: 143 - RNA, 21 nt, Artificial Sequence
  Synthetic
  misc_feature (4)..(7): 2'-O-methyl
  misc_feature (8)..(8): 2'-deoxy-2'-fluoro
  misc_feature (9)..(9): 2'-O-methyl
  misc_feature (10)..(10): 2'-deoxy-2'-fluoro
  misc_feature (11)..(12): 2'-O-methyl
  misc_feature (13)..(13): 2'-deoxy-2'-fluoro
  misc_feature (15)..(15): 2'-O-methyl
  misc_feature (16)..(16): 2'-deoxy-2'-fluoro
  misc_feature (17)..(21): 2'-O-methyl
gaugaggcauagcagcagguu

SEQ ID NO: 144 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucugccgauccauacugctt

SEQ ID NO: 145 - RNA, 21 nt, Artificial Sequence
  Synthetic
  misc_feature (20)..(21): 2'-O-methyl
gcaguauggaucggcagaguu

SEQ ID NO: 146 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(5): 2'-deoxy
  misc_feature (6)..(8): 2'-deoxy-2'-fluoro
  misc_feature (9)..(11): 2'-deoxy
  misc_feature (12)..(14): 2'-deoxy-2'-fluoro
  misc_feature (15)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
cagagucuagacucguggutt

SEQ ID NO: 147 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(8): 2'-O-methyl
  misc_feature (9)..(11): 2'-deoxy-2'-fluoro
  misc_feature (12)..(13): 2'-O-methyl
  misc_feature (15)..(18): 2'-deoxy-2'-fluoro
  misc_feature (19)..(21): 2'-O-methyl
accacgagucuagacucuguu

SEQ ID NO: 148 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(4): 2'-deoxy
  misc_feature (5)..(6): 2'-deoxy-2'-fluoro
  misc_feature (7)..(7): 2'-deoxy
  misc_feature (8)..(8): 2'-deoxy-2'-fluoro
  misc_feature (9)..(9): 2'-deoxy
  misc_feature (10)..(13): 2'-deoxy-2'-fluoro
  misc_feature (14)..(14): 2'-deoxy
  misc_feature (15)..(19): 2'-deoxy-2'-fluoro
  misc_feature (21)..(21): inverted abasic cap
gcugcuaugccucaucuuctt

SEQ ID NO: 149 - RNA, 21 nt, Artificial Sequence
  Synthetic
  misc_feature (4)..(5): 2'-O-methyl
  misc_feature (6)..(6): 2'-deoxy-2'-fluoro
  misc_feature (7)..(10): 2'-O-methyl
  misc_feature (11)..(11): 2'-deoxy-2'-fluoro
  misc_feature (12)..(12): 2'-O-methyl
  misc_feature (13)..(13): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
gaagaugaggcauagcagcuu

SEQ ID NO: 150 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccucugccgauccauacugtt

SEQ ID NO: 151 - RNA, 21 nt, Artificial Sequence
  Synthetic
  misc_feature (20)..(21): 2'-O-methyl
caguauggaucggcagagguu

SEQ ID NO: 152 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(6): 2'-deoxy
  misc_feature (7)..(9): 2'-deoxy-2'-fluoro
  misc_feature (10)..(10): 2'-deoxy
  misc_feature (11)..(11): 2'-deoxy-2'-fluoro
  misc_feature (12)..(13): 2'-deoxy
  misc_feature (14)..(14): 2'-deoxy-2'-fluoro
  misc_feature (15)..(17): 2'-deoxy
  misc_feature (18)..(19): 2'-deoxy-2'-fluoro
  misc_feature (21)..(21): inverted abasic cap
ucuagacucgugguggacutt

SEQ ID NO: 153 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(8): 2'-deoxy-2'-fluoro
  misc_feature (9)..(9): 2'-O-methyl
  misc_feature (10)..(10): 2'-deoxy-2'-fluoro
  misc_feature (11)..(13): 2'-O-methyl
  misc_feature (14)..(16): 2'-deoxy-2'-fluoro
  misc_feature (17)..(21): 2'-O-methyl
aguccaccacgagucuagauu

SEQ ID NO: 154 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(6): 2'-deoxy-2'-fluoro
  misc_feature (7)..(7): 2'-deoxy
  misc_feature (8)..(9): 2'-deoxy-2'-fluoro
  misc_feature (10)..(10): 2'-deoxy
  misc_feature (11)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(19): 2'-deoxy-2'-fluoro
  misc_feature (21)..(21): inverted abasic cap
cauccugcugcuaugccuctt

SEQ ID NO: 155 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(9): 2'-O-methyl
  misc_feature (10)..(10): 2'-deoxy-2'-fluoro
  misc_feature (11)..(12): 2'-O-methyl
  misc_feature (13)..(13): 2'-deoxy-2'-fluoro
  misc_feature (15)..(17): 2'-O-methyl
  misc_feature (18)..(18): 2'-deoxy-2'-fluoro
  misc_feature (19)..(21): 2'-O-methyl
gaggcauagcagcaggauguu

SEQ ID NO: 156 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(5): 2'-deoxy-2'-fluoro
  misc_feature (6)..(8): 2'-deoxy
  misc_feature (9)..(11): 2'-deoxy-2'-fluoro
  misc_feature (12)..(12): 2'-deoxy
  misc_feature (13)..(13): 2'-deoxy-2'-fluoro
  misc_feature (14)..(15): 2'-deoxy
  misc_feature (16)..(16): 2'-deoxy-2'-fluoro
  misc_feature (17)..(19): 2'-deoxy
  misc_feature (21)..(21): inverted abasic cap
agucuagacucgugguggatt

SEQ ID NO: 157 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(7): 2'-O-methyl
  misc_feature (8)..(8): 2'-deoxy-2'-fluoro
  misc_feature (9)..(11): 2'-O-methyl
  misc_feature (12)..(14): 2'-deoxy-2'-fluoro
  misc_feature (15)..(17): 2'-O-methyl
  misc_feature (18)..(19): 2'-deoxy-2'-fluoro
  misc_feature (20)..(21): 2'-O-methyl
uccaccacgagucuagacuuu

SEQ ID NO: 158 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (8)..(10): 2'-deoxy
  misc_feature (11)..(13): 2'-deoxy-2'-fluoro
  misc_feature (14)..(14): 2'-deoxy
  misc_feature (15)..(15): 2'-deoxy-2'-fluoro
  misc_feature (16)..(16): 2'-deoxy
  misc_feature (17)..(19): 2'-deoxy-2'-fluoro
  misc_feature (21)..(21): inverted abasic cap
ggaguguggauucgcacuctt

SEQ ID NO: 159 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(9): 2'-O-methyl
  misc_feature (10)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(19): 2'-deoxy-2'-fluoro
  misc_feature (20)..(21): 2'-O-methyl
gagugcgaauccacacuccuu

SEQ ID NO: 160 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(5): 2'-deoxy
  misc_feature (6)..(7): 2'-deoxy-2'-fluoro
  misc_feature (8)..(8): 2'-deoxy
  misc_feature (9)..(9): 2'-deoxy-2'-fluoro
  misc_feature (10)..(10): 2'-deoxy
  misc_feature (11)..(14): 2'-deoxy-2'-fluoro
  misc_feature (15)..(15): 2'-deoxy
  misc_feature (16)..(19): 2'-deoxy-2'-fluoro
  misc_feature (21)..(21): inverted abasic cap
ugcugcuaugccucaucuutt

SEQ ID NO: 161 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(9): 2'-O-methyl
  misc_feature (10)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (15)..(15): 2'-deoxy-2'-fluoro
  misc_feature (16)..(17): 2'-O-methyl
  misc_feature (18)..(18): 2'-deoxy-2'-fluoro
  misc_feature (19)..(21): 2'-O-methyl
aagaugaggcauagcagcauu

SEQ ID NO: 162 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(8): 2'-deoxy-2'-fluoro
  misc_feature (9)..(9): 2'-deoxy
  misc_feature (10)..(10): 2'-deoxy-2'-fluoro
  misc_feature (11)..(14): 2'-deoxy
  misc_feature (15)..(19): 2'-deoxy-2'-fluoro
  misc_feature (21)..(21): inverted abasic cap
uccauacugcggaacuccutt

SEQ ID NO: 163 - RNA, 21 nt, Artificial Sequence
  Synthetic
  misc_feature (4)..(5): 2'-O-methyl
  misc_feature (6)..(9): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(21): 2'-O-methyl
aggaguuccgcaguauggauu

SEQ ID NO: 164 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuccucugccgauccauactt

SEQ ID NO: 165 - RNA, 21 nt, Artificial Sequence
  Synthetic
  misc_feature (20)..(21): 2'-O-methyl
guauggaucggcagaggaguu

SEQ ID NO: 166 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(5): 2'-deoxy-2'-fluoro
  misc_feature (6)..(6): 2'-deoxy
  misc_feature (7)..(7): 2'-deoxy-2'-fluoro
  misc_feature (8)..(8): 2'-deoxy
  misc_feature (9)..(10): 2'-deoxy-2'-fluoro
  misc_feature (11)..(11): 2'-deoxy
  misc_feature (12)..(12): 2'-deoxy-2'-fluoro
  misc_feature (13)..(16): 2'-deoxy
  misc_feature (17)..(19): 2'-deoxy-2'-fluoro
  misc_feature (21)..(21): inverted abasic cap
gauccauacugcggaacuctt

SEQ ID NO: 167 - RNA, 21 nt, Artificial Sequence
  Synthetic
  misc_feature (4)..(7): 2'-deoxy-2'-fluoro
  misc_feature (8)..(8): 2'-O-methyl
  misc_feature (9)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (14)..(14): 2'-deoxy-2'-fluoro
  misc_feature (15)..(17): 2'-O-methyl
  misc_feature (18)..(19): 2'-deoxy-2'-fluoro
  misc_feature (20)..(21): 2'-O-methyl
gaguuccgcaguauggaucuu

SEQ ID NO: 168 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(6): 2'-deoxy
  misc_feature (7)..(13): 2'-deoxy-2'-fluoro
  misc_feature (14)..(14): 2'-deoxy
  misc_feature (15)..(18): 2'-deoxy-2'-fluoro
  misc_feature (19)..(19): 2'-deoxy
  misc_feature (21)..(21): inverted abasic cap
gaagaacucccucgccucgtt

SEQ ID NO: 169 - RNA, 21 nt, Artificial Sequence
  Synthetic
  misc_feature (4)..(5): 2'-O-methyl
  misc_feature (6)..(6): 2'-deoxy-2'-fluoro
  misc_feature (7)..(13): 2'-O-methyl
  misc_feature (14)..(19): 2'-deoxy-2'-fluoro
  misc_feature (20)..(21): 2'-O-methyl
cgaggcgagggaguucuucuu

SEQ ID NO: 170 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(3): 2'-deoxy
  misc_feature (4)..(4): 2'-deoxy-2'-fluoro
  misc_feature (5)..(6): 2'-deoxy
  misc_feature (7)..(7): 2'-deoxy-2'-fluoro
  misc_feature (8)..(10): 2'-deoxy
  misc_feature (11)..(18): 2'-deoxy-2'-fluoro
  misc_feature (19)..(19): 2'-deoxy
  misc_feature (21)..(21): inverted abasic cap
ucgugguggacuucucucatt

SEQ ID NO: 171 - RNA, 21 nt, Artificial Sequence
  Synthetic
  misc_feature (4)..(9): 2'-O-methyl
  misc_feature (10)..(12): 2'-deoxy-2'-fluoro
  misc_feature (13)..(13): 2'-O-methyl
  misc_feature (14)..(15): 2'-deoxy-2'-fluoro
  misc_feature (16)..(16): 2'-O-methyl
  misc_feature (17)..(17): 2'-deoxy-2'-fluoro
  misc_feature (18)..(21): 2'-O-methyl
ugagagaaguccaccacgauu

SEQ ID NO: 172 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(4): 2'-deoxy-2'-fluoro
  misc_feature (5)..(5): 2'-deoxy
  misc_feature (6)..(7): 2'-deoxy-2'-fluoro
  misc_feature (8)..(8): 2'-deoxy
  misc_feature (9)..(10): 2'-deoxy-2'-fluoro
  misc_feature (11)..(11): 2'-deoxy
  misc_feature (12)..(12): 2'-deoxy-2'-fluoro
  misc_feature (13)..(13): 2'-deoxy
  misc_feature (14)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
uccugcugcuaugccucautt

SEQ ID NO: 173 - RNA, 21 nt, Artificial Sequence
  Synthetic
  misc_feature (4)..(6): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (15)..(15): 2'-deoxy-2'-fluoro
  misc_feature (16)..(21): 2'-O-methyl
augaggcauagcagcaggauu

SEQ ID NO: 174 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auccauacugcggaacucctt

SEQ ID NO: 175 - RNA, 21 nt, Artificial Sequence
  Synthetic
  misc_feature (20)..(21): 2'-O-methyl
ggaguuccgcaguauggauuu

SEQ ID NO: 176 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggcucaguuuacuagugctt

SEQ ID NO: 177 - RNA, 21 nt, Artificial Sequence
  Synthetic
  misc_feature (20)..(21): 2'-O-methyl
gcacuaguaaacugagccauu

SEQ ID NO: 178 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagccuccaagcugugccutt

SEQ ID NO: 179 - RNA, 21 nt, Artificial Sequence
  Synthetic
  misc_feature (20)..(21): 2'-O-methyl
aggcacagcuuggaggcuuuu

SEQ ID NO: 180 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(7): 2'-deoxy
  misc_feature (8)..(14): 2'-deoxy-2'-fluoro
  misc_feature (15)..(15): 2'-deoxy
  misc_feature (16)..(19): 2'-deoxy-2'-fluoro
  misc_feature (21)..(21): inverted abasic cap
agaagaacucccucgccuctt

SEQ ID NO: 181 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(12): 2'-O-methyl
  misc_feature (13)..(19): 2'-deoxy-2'-fluoro
  misc_feature (20)..(21): 2'-O-methyl
gaggcgagggaguucuucuuu

SEQ ID NO: 182 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(4): 2'-deoxy-2'-fluoro
  misc_feature (5)..(7): 2'-deoxy
  misc_feature (8)..(10): 2'-deoxy-2'-fluoro
  misc_feature (11)..(11): 2'-deoxy
  misc_feature (12)..(12): 2'-deoxy-2'-fluoro
  misc_feature (13)..(14): 2'-deoxy
  misc_feature (15)..(15): 2'-deoxy-2'-fluoro
  misc_feature (16)..(18): 2'-deoxy
  misc_feature (19)..(19): 2'-deoxy-2'-fluoro
  misc_feature (21)..(21): inverted abasic cap
gucuagacucgugguggactt

SEQ ID NO: 183 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(7): 2'-deoxy-2'-fluoro
  misc_feature (8)..(8): 2'-O-methyl
  misc_feature (9)..(9): 2'-deoxy-2'-fluoro
  misc_feature (10)..(12): 2'-O-methyl
  misc_feature (13)..(15): 2'-deoxy-2'-fluoro
  misc_feature (16)..(18): 2'-O-methyl
  misc_feature (19)..(19): 2'-deoxy-2'-fluoro
  misc_feature (20)..(21): 2'-O-methyl
guccaccacgagucuagacuu

SEQ ID NO: 184 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(3): 2'-deoxy
  misc_feature (4)..(5): 2'-deoxy-2'-fluoro
  misc_feature (6)..(6): 2'-deoxy
  misc_feature (7)..(8): 2'-deoxy-2'-fluoro
  misc_feature (9)..(9): 2'-deoxy
  misc_feature (10)..(10): 2'-deoxy-2'-fluoro
  misc_feature (11)..(11): 2'-deoxy
  misc_feature (12)..(15): 2'-deoxy-2'-fluoro
  misc_feature (16)..(16): 2'-deoxy
  misc_feature (17)..(19): 2'-deoxy-2'-fluoro
  misc_feature (21)..(21): inverted abasic cap
cugcugcuaugccucaucutt

SEQ ID NO: 185 - RNA, 21 nt, Artificial Sequence
  Synthetic
  misc_feature (4)..(4): 2'-deoxy-2'-fluoro
  misc_feature (5)..(8): 2'-O-methyl
  misc_feature (9)..(9): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(16): 2'-O-methyl
  misc_feature (17)..(17): 2'-deoxy-2'-fluoro
  misc_feature (18)..(21): 2'-O-methyl
agaugaggcauagcagcaguu

SEQ ID NO: 186 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(3): 2'-deoxy
  misc_feature (4)..(5): 2'-deoxy-2'-fluoro
  misc_feature (6)..(7): 2'-deoxy
  misc_feature (8)..(10): 2'-deoxy-2'-fluoro
  misc_feature (11)..(11): 2'-deoxy
  misc_feature (12)..(12): 2'-deoxy-2'-fluoro
  misc_feature (13)..(13): 2'-deoxy
  misc_feature (14)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (21)..(21): inverted abasic cap
cugccgauccauacugcggtt

SEQ ID NO: 187 - RNA, 21 nt, Artificial Sequence
  Synthetic
  misc_feature (4)..(4): 2'-deoxy-2'-fluoro
  misc_feature (5)..(6): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(12): 2'-O-methyl
  misc_feature (13)..(14): 2'-deoxy-2'-fluoro
  misc_feature (15)..(16): 2'-O-methyl
  misc_feature (17)..(17): 2'-deoxy-2'-fluoro
  misc_feature (18)..(21): 2'-O-methyl
ccgcaguauggaucggcaguu

SEQ ID NO: 188 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(6): 2'-deoxy
  misc_feature (7)..(11): 2'-deoxy-2'-fluoro
  misc_feature (12)..(14): 2'-deoxy
  misc_feature (15)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (21)..(21): inverted abasic cap
uucaagccuccaagcugugtt

SEQ ID NO: 189 - RNA, 21 nt, Artificial Sequence
  Synthetic
  misc_feature (4)..(5): 2'-O-methyl
  misc_feature (6)..(8): 2'-deoxy-2'-fluoro
  misc_feature (9)..(13): 2'-O-methyl
  misc_feature (14)..(16): 2'-deoxy-2'-fluoro
  misc_feature (17)..(21): 2'-O-methyl
cacagcuuggaggcuugaauu

SEQ ID NO: 190 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agucuagacucgugguggatt

SEQ ID NO: 191 - RNA, 21 nt, Artificial Sequence
  Synthetic
  misc_feature (20)..(21): 2'-O-methyl
uccaccacgagucuagacuuu

SEQ ID NO: 192 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gucuagacucgugguggactt

SEQ ID NO: 193 - RNA, 21 nt, Artificial Sequence
  Synthetic
  misc_feature (20)..(21): 2'-O-methyl
guccaccacgagucuagacuu

SEQ ID NO: 194 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuaugggagugggccucagtt

SEQ ID NO: 195 - RNA, 21 nt, Artificial Sequence
  Synthetic
  misc_feature (20)..(21): 2'-O-methyl
cugaggcccacucccauaguu

SEQ ID NO: 196 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucaagccuccaagcugugtt

SEQ ID NO: 197 - RNA, 21 nt, Artificial Sequence
  Synthetic
  misc_feature (20)..(21): 2'-O-methyl
cacagcuuggaggcuugaauu

SEQ ID NO: 198 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(5): 2'-deoxy-2'-fluoro
  misc_feature (6)..(6): 2'-deoxy
  misc_feature (7)..(7): 2'-deoxy-2'-fluoro
  misc_feature (8)..(9): 2'-deoxy
  misc_feature (10)..(10): 2'-deoxy-2'-fluoro
  misc_feature (11)..(13): 2'-deoxy
  misc_feature (14)..(19): 2'-deoxy-2'-fluoro
  misc_feature (21)..(21): inverted abasic cap
gacucgugguggacuucuctt

SEQ ID NO: 199 - RNA, 21 nt, Artificial Sequence
  Synthetic
  misc_feature (4)..(6): 2'-O-methyl
  misc_feature (7)..(9): 2'-deoxy-2'-fluoro
  misc_feature (10)..(10): 2'-O-methyl
  misc_feature (11)..(12): 2'-deoxy-2'-fluoro
  misc_feature (13)..(13): 2'-O-methyl
  misc_feature (14)..(14): 2'-deoxy-2'-fluoro
  misc_feature (15)..(17): 2'-O-methyl
  misc_feature (18)..(19): 2'-deoxy-2'-fluoro
  misc_feature (20)..(21): 2'-O-methyl
gagaaguccaccacgagucuu

SEQ ID NO: 200 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcugcuaugccucaucuuctt

SEQ ID NO: 201 - RNA, 21 nt, Artificial Sequence
  Synthetic
  misc_feature (20)..(21): 2'-O-methyl
gaagaugaggcauagcagcuu

SEQ ID NO: 202 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(5): 2'-deoxy
  misc_feature (6)..(6): 2'-deoxy-2'-fluoro
  misc_feature (7)..(9): 2'-deoxy
  misc_feature (10)..(17): 2'-deoxy-2'-fluoro
  misc_feature (18)..(19): 2'-deoxy
  misc_feature (21)..(21): inverted abasic cap
cgugguggacuucucucaatt

SEQ ID NO: 203 - RNA, 21 nt, Artificial Sequence
  Synthetic
  misc_feature (4)..(10): 2'-O-methyl
  misc_feature (11)..(13): 2'-deoxy-2'-fluoro
  misc_feature (15)..(16): 2'-deoxy-2'-fluoro
  misc_feature (17)..(17): 2'-O-methyl
  misc_feature (18)..(18): 2'-deoxy-2'-fluoro
  misc_feature (19)..(21): 2'-O-methyl
uugagagaaguccaccacguu

SEQ ID NO: 204 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(3): 2'-deoxy
  misc_feature (4)..(6): 2'-deoxy-2'-fluoro
  misc_feature (7)..(8): 2'-deoxy
  misc_feature (9)..(11): 2'-deoxy-2'-fluoro
  misc_feature (12)..(12): 2'-deoxy
  misc_feature (13)..(14): 2'-deoxy-2'-fluoro
  misc_feature (15)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
uggcucaguuuacuagugctt

SEQ ID NO: 205 - RNA, 21 nt, Artificial Sequence
  Synthetic
  misc_feature (4)..(5): 2'-deoxy-2'-fluoro
  misc_feature (6)..(7): 2'-O-methyl
  misc_feature (8)..(8): 2'-deoxy-2'-fluoro
  misc_feature (9)..(11): 2'-O-methyl
  misc_feature (12)..(13): 2'-deoxy-2'-fluoro
  misc_feature (15)..(16): 2'-O-methyl
  misc_feature (17)..(18): 2'-deoxy-2'-fluoro
  misc_feature (19)..(21): 2'-O-methyl
gcacuaguaaacugagccauu

SEQ ID NO: 206 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(7): 2'-deoxy-2'-fluoro
  misc_feature (8)..(8): 2'-deoxy
  misc_feature (9)..(10): 2'-deoxy-2'-fluoro
  misc_feature (11)..(12): 2'-deoxy
  misc_feature (13)..(15): 2'-deoxy-2'-fluoro
  misc_feature (16)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
cuccucugccgauccauactt

SEQ ID NO: 207 - RNA, 21 nt, Artificial Sequence
  Synthetic
  misc_feature (4)..(4): 2'-deoxy-2'-fluoro
  misc_feature (5)..(7): 2'-O-methyl
  misc_feature (8)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (15)..(21): 2'-O-methyl
guauggaucggcagaggaguu

SEQ ID NO: 208 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy
  misc_feature (4)..(4): 2'-deoxy-2'-fluoro
  misc_feature (5)..(5): 2'-deoxy
  misc_feature (6)..(6): 2'-deoxy-2'-fluoro
  misc_feature (7)..(9): 2'-deoxy
  misc_feature (10)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(19): 2'-deoxy-2'-fluoro
  misc_feature (21)..(21): inverted abasic cap
gaguguggauucgcacucctt

SEQ ID NO: 209 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(10): 2'-O-methyl
  misc_feature (11)..(13): 2'-deoxy-2'-fluoro
  misc_feature (15)..(15): 2'-deoxy-2'-fluoro
  misc_feature (16)..(16): 2'-O-methyl
  misc_feature (17)..(19): 2'-deoxy-2'-fluoro
  misc_feature (20)..(21): 2'-O-methyl
ggagugcgaauccacacucuu

SEQ ID NO: 210 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(4): 2'-deoxy
  misc_feature (5)..(13): 2'-deoxy-2'-fluoro
  misc_feature (14)..(14): 2'-deoxy
  misc_feature (15)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (21)..(21): inverted abasic cap
cgcaccucucuuuacgcggtt

SEQ ID NO: 211 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(13): 2'-O-methyl
  misc_feature (15)..(15): 2'-O-methyl
  misc_feature (16)..(16): 2'-deoxy-2'-fluoro
  misc_feature (17)..(17): 2'-O-methyl
  misc_feature (18)..(18): 2'-deoxy-2'-fluoro
  misc_feature (19)..(21): 2'-O-methyl
ccgcguaaagagaggugcguu

SEQ ID NO: 212 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccgauccauacugcggaactt

SEQ ID NO: 213 - RNA, 21 nt, Artificial Sequence
  Synthetic
  misc_feature (20)..(21): 2'-O-methyl
guuccgcaguauggaucgguu

SEQ ID NO: 214 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(3): 2'-deoxy
  misc_feature (4)..(4): 2'-deoxy-2'-fluoro
  misc_feature (5)..(9): 2'-deoxy
  misc_feature (10)..(10): 2'-deoxy-2'-fluoro
  misc_feature (11)..(13): 2'-deoxy
  misc_feature (14)..(17): 2'-deoxy-2'-fluoro
  misc_feature (18)..(19): 2'-deoxy
  misc_feature (21)..(21): inverted abasic cap
cuaugggagugggccucagtt

SEQ ID NO: 215 - RNA, 21 nt, Artificial Sequence
  Synthetic
  misc_feature (4)..(6): 2'-O-methyl
  misc_feature (7)..(9): 2'-deoxy-2'-fluoro
  misc_feature (10)..(10): 2'-O-methyl
  misc_feature (11)..(15): 2'-deoxy-2'-fluoro
  misc_feature (16)..(16): 2'-O-methyl
  misc_feature (17)..(17): 2'-deoxy-2'-fluoro
  misc_feature (18)..(21): 2'-O-methyl
cugaggcccacucccauaguu

SEQ ID NO: 216 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagaagaacucccucgccutt

SEQ ID NO: 217 - RNA, 21 nt, Artificial Sequence
  Synthetic
  misc_feature (20)..(21): 2'-O-methyl
aggcgagggaguucuucuuuu

SEQ ID NO: 218 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(5): 2'-deoxy
  misc_feature (6)..(8): 2'-deoxy-2'-fluoro
  misc_feature (9)..(9): 2'-deoxy
  misc_feature (10)..(10): 2'-deoxy-2'-fluoro
  misc_feature (11)..(11): 2'-deoxy
  misc_feature (12)..(13): 2'-deoxy-2'-fluoro
  misc_feature (14)..(14): 2'-deoxy
  misc_feature (15)..(15): 2'-deoxy-2'-fluoro
  misc_feature (16)..(19): 2'-deoxy
  misc_feature (21)..(21): inverted abasic cap
gccgauccauacugcggaatt

SEQ ID NO: 219 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(8): 2'-O-methyl
  misc_feature (9)..(9): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (15)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
uuccgcaguauggaucggcuu

SEQ ID NO: 220 - RNA, 21 nt, Artificial Sequence
  Synthetic
  misc_feature (1)..(1): inverted abasic cap
  misc_feature (1)..(2): 2'-deoxy-2'-fluoro
  misc_feature (3)..(4): 2'-O-methyl
  misc_feature (5)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(12): 2'-deoxy-2'-fluoro
  misc_feature (13)..(13): 2'-O-methyl
  misc_feature (14)..(14): 2'-deoxy-2'-fluoro
  misc_feature (15)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 221 - RNA, 21 nt, Artificial Sequence
  Synthetic
  misc_feature (6)..(6): 2'-O-methyl
  misc_feature (8)..(9): 2'-O-methyl
  misc_feature (11)..(11): 2'-O-methyl
  misc_feature (13)..(13): 2'-O-methyl
  misc_feature (15)..(15): 2'-O-methyl
  misc_feature (18)..(21): 2'-O-methyl
  misc_feature (20)..(21): phosphorothioate linkage
guuccgcaguauggaucgguu

SEQ ID NO: 222 - RNA, 21 nt, Artificial Sequence
  Synthetic
  misc_feature (1)..(1): inverted abasic cap
  misc_feature (3)..(4): 2'-O-methyl
  misc_feature (8)..(8): 2'-O-methyl
  misc_feature (10)..(10): 2'-O-methyl
  misc_feature (13)..(13): 2'-O-methyl
  misc_feature (15)..(18): 2'-O-methyl
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 223 - RNA, 21 nt, Artificial Sequence
  Synthetic
  misc_feature (2)..(5): 2'-deoxy-2'-fluoro
  misc_feature (7)..(7): 2'-deoxy-2'-fluoro
  misc_feature (10)..(10): 2'-deoxy-2'-fluoro
  misc_feature (12)..(12): 2'-deoxy-2'-fluoro
  misc_feature (16)..(17): 2'-deoxy-2'-fluoro
  misc_feature (20)..(21): 2'-O-methyl
  misc_feature (20)..(21): phosphorothioate linkage
guuccgcaguauggaucgguu

SEQ ID NO: 224 - RNA, 21 nt, Artificial Sequence
  Synthetic
  misc_feature (1)..(1): inverted abasic cap
  misc_feature (1)..(1): 2'-O-methyl
  misc_feature (2)..(3): 2'-deoxy-2'-fluoro
  misc_feature (4)..(5): 2'-O-methyl
  misc_feature (6)..(8): 2'-deoxy-2'-fluoro
  misc_feature (9)..(9): 2'-O-methyl
  misc_feature (10)..(10): 2'-deoxy-2'-fluoro
  misc_feature (11)..(11): 2'-O-methyl
  misc_feature (12)..(13): 2'-deoxy-2'-fluoro
  misc_feature (14)..(14): 2'-O-methyl
  misc_feature (15)..(15): 2'-deoxy-2'-fluoro
  misc_feature (16)..(21): 2'-O-methyl
  misc_feature (20)..(21): phosphorothioate linkage
  misc_feature (21)..(21): inverted abasic cap
gccgauccauacugcggaauu

SEQ ID NO: 225 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(8): 2'-deoxy-2'-fluoro
  misc_feature (9)..(9): 2'-O-methyl
  misc_feature (10)..(10): 2'-deoxy-2'-fluoro
  misc_feature (11)..(11): 2'-O-methyl
  misc_feature (12)..(14): 2'-deoxy-2'-fluoro
  misc_feature (15)..(16): 2'-O-methyl
  misc_feature (17)..(18): 2'-deoxy-2'-fluoro
  misc_feature (19)..(21): 2'-O-methyl
  misc_feature (20)..(21): phosphorothioate linkage
uuccgcaguauggaucggcuu

SEQ ID NO: 226 - RNA, 21 nt, Artificial Sequence
  Synthetic
  misc_feature (1)..(1): inverted abasic cap
  misc_feature (2)..(3): 2'-O-methyl
  misc_feature (6)..(8): 2'-O-methyl
  misc_feature (10)..(10): 2'-O-methyl
  misc_feature (12)..(13): 2'-O-methyl
  misc_feature (15)..(15): 2'-O-methyl
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 227 - RNA, 21 nt, Artificial Sequence
  Synthetic
  misc_feature (5)..(5): 2'-deoxy-2'-fluoro
  misc_feature (7)..(8): 2'-deoxy-2'-fluoro
  misc_feature (10)..(10): 2'-deoxy-2'-fluoro
  misc_feature (12)..(14): 2'-deoxy-2'-fluoro
  misc_feature (17)..(18): 2'-deoxy-2'-fluoro
  misc_feature (20)..(21): 2'-O-methyl
  misc_feature (20)..(21): phosphorothioate linkage
uuccgcaguauggaucggcuu

SEQ ID NO: 228 - RNA, 21 nt, Artificial Sequence
  Synthetic
  misc_feature (1)..(4): 2'-deoxy-2'-fluoro
  misc_feature (6)..(6): 2'-deoxy-2'-fluoro
  misc_feature (9)..(9): 2'-deoxy-2'-fluoro
  misc_feature (11)..(11): 2'-deoxy-2'-fluoro
  misc_feature (15)..(16): 2'-deoxy-2'-fluoro
  misc_feature (19)..(19): 2'-deoxy-2'-fluoro
  misc_feature (20)..(21): 2'-O-methyl
  misc_feature (20)..(21): phosphorothioate linkage
uuccgcaguauggaucggcuu

SEQ ID NO: 229 - RNA, 21 nt, Artificial Sequence
  Synthetic
  misc_feature (1)..(1): inverted abasic cap
  misc_feature (1)..(1): 2'-deoxy
  misc_feature (2)..(3): 2'-deoxy-2'-fluoro
  misc_feature (4)..(5): 2'-deoxy
  misc_feature (6)..(8): 2'-deoxy-2'-fluoro
  misc_feature (9)..(9): 2'-deoxy
  misc_feature (10)..(10): 2'-deoxy-2'-fluoro
  misc_feature (11)..(11): 2'-deoxy
  misc_feature (12)..(13): 2'-deoxy-2'-fluoro
  misc_feature (14)..(14): 2'-deoxy
  misc_feature (15)..(15): 2'-deoxy-2'-fluoro
  misc_feature (16)..(19): 2'-deoxy
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 230 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(8): 2'-O-methyl
  misc_feature (9)..(9): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (15)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
uuccgcaguauggaucggcuu

SEQ ID NO: 231 - RNA, 21 nt, Artificial Sequence
  Synthetic
  misc_feature (1)..(1): inverted abasic cap
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 232 - RNA, 21 nt, Artificial Sequence
  Synthetic
  misc_feature (20)..(21): 2'-O-methyl
  misc_feature (20)..(21): phosphorothioate linkage
uuccgcaguauggaucggcuu

SEQ ID NO: 233 - RNA, 21 nt, Artificial Sequence
  Synthetic
  misc_feature (1)..(1): inverted abasic cap
  misc_feature (1)..(1): 2'-O-methyl
  misc_feature (2)..(2): 2'-deoxy-2'-fluoro
  misc_feature (3)..(4): 2'-O-methyl
  misc_feature (5)..(5): 2'-deoxy-2'-fluoro
  misc_feature (6)..(8): 2'-O-methyl
  misc_feature (9)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 234 - RNA, 21 nt, Artificial Sequence
  Synthetic
  misc_feature (2)..(3): 2'-deoxy-2'-fluoro
  misc_feature (12)..(14): 2'-deoxy-2'-fluoro
  misc_feature (16)..(17): 2'-deoxy-2'-fluoro
  misc_feature (19)..(19): 2'-deoxy-2'-fluoro
  misc_feature (20)..(21): 2'-O-methyl
  misc_feature (20)..(21): phosphorothioate linkage
auugagagaaguccaccacuu

SEQ ID NO: 235 - RNA, 21 nt, Artificial Sequence
  Synthetic
  misc_feature (1)..(1): inverted abasic cap
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 236 - RNA, 21 nt, Artificial Sequence
  Synthetic
  misc_feature (20)..(21): 2'-O-methyl
  misc_feature (20)..(21): phosphorothioate linkage
auugagagaaguccaccacuu

SEQ ID NO: 237 - RNA, 21 nt, Artificial Sequence
  Synthetic
  misc_feature (1)..(1): inverted abasic cap
  misc_feature (1)..(2): 2'-deoxy-2'-fluoro
  misc_feature (3)..(3): 2'-O-methyl
  misc_feature (4)..(4): 2'-deoxy-2'-fluoro
  misc_feature (5)..(6): 2'-O-methyl
  misc_feature (7)..(7): 2'-deoxy-2'-fluoro
  misc_feature (8)..(10): 2'-O-methyl
  misc_feature (11)..(18): 2'-deoxy-2'-fluoro
  misc_feature (19)..(21): 2'-O-methyl
  misc_feature (20)..(21): phosphorothioate linkage
  misc_feature (21)..(21): inverted abasic cap
ucgugguggacuucucucauu

SEQ ID NO: 238 - RNA, 21 nt, Artificial Sequence
  Synthetic
  misc_feature (4)..(9): 2'-deoxy-2'-fluoro
  misc_feature (10)..(12): 2'-O-methyl
  misc_feature (13)..(13): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
  misc_feature (20)..(21): phosphorothioate linkage
ugagagaaguccaccacgauu

SEQ ID NO: 239 - RNA, 21 nt, Artificial Sequence
  Synthetic
  misc_feature (4)..(9): 2'-O-methyl
  misc_feature (10)..(12): 2'-deoxy-2'-fluoro
  misc_feature (13)..(13): 2'-O-methyl
  misc_feature (14)..(15): 2'-deoxy-2'-fluoro
  misc_feature (16)..(16): 2'-O-methyl
  misc_feature (17)..(17): 2'-deoxy-2'-fluoro
  misc_feature (18)..(21): 2'-O-methyl
  misc_feature (20)..(21): phosphorothioate linkage
ugagagaaguccaccacgauu

SEQ ID NO: 240 - RNA, 21 nt, Artificial Sequence
  Synthetic
  misc_feature (10)..(12): 2'-O-methyl
  misc_feature (15)..(15): 2'-O-methyl
  misc_feature (17)..(17): 2'-O-methyl
  misc_feature (20)..(21): 2'-O-methyl
  misc_feature (20)..(21): phosphorothioate linkage
ugagagaaguccaccacgauu

SEQ ID NO: 241 - RNA, 21 nt, Artificial Sequence
  Synthetic
  misc_feature (1)..(1): inverted abasic cap
  misc_feature (1)..(2): 2'-O-methyl
  misc_feature (4)..(4): 2'-O-methyl
  misc_feature (7)..(7): 2'-O-methyl
  misc_feature (11)..(18): 2'-O-methyl
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 242 - RNA, 21 nt, Artificial Sequence
  Synthetic
  misc_feature (4)..(9): 2'-deoxy-2'-fluoro
  misc_feature (13)..(13): 2'-deoxy-2'-fluoro
  misc_feature (16)..(16): 2'-deoxy-2'-fluoro
  misc_feature (18)..(19): 2'-deoxy-2'-fluoro
  misc_feature (20)..(21): 2'-O-methyl
  misc_feature (20)..(21): phosphorothioate linkage
ugagagaaguccaccacgauu

SEQ ID NO: 243 - RNA, 21 nt, Artificial Sequence
  Synthetic
  misc_feature (1)..(1): 2'-deoxy-2'-fluoro
  misc_feature (10)..(12): 2'-deoxy-2'-fluoro
  misc_feature (14)..(15): 2'-deoxy-2'-fluoro
  misc_feature (17)..(17): 2'-deoxy-2'-fluoro
  misc_feature (20)..(21): 2'-O-methyl
  misc_feature (20)..(21): phosphorothioate linkage
ugagagaaguccaccacgauu

SEQ ID NO: 244 - RNA, 21 nt, Artificial Sequence
  Synthetic
  misc_feature (1)..(1): inverted abasic cap
  misc_feature (3)..(3): 2'-O-methyl
  misc_feature (5)..(6): 2'-O-methyl
  misc_feature (8)..(10): 2'-O-methyl
  misc_feature (19)..(21): 2'-O-methyl
  misc_feature (20)..(21): phosphorothioate linkage
  misc_feature (21)..(21): inverted abasic cap
ucgugguggacuucucucauu

SEQ ID NO: 245 - RNA, 21 nt, Artificial Sequence
  Synthetic
  misc_feature (1)..(1): inverted abasic cap
  misc_feature (1)..(2): 2'-deoxy-2'-fluoro
  misc_feature (3)..(4): 2'-deoxy
  misc_feature (5)..(7): 2'-deoxy-2'-fluoro
  misc_feature (8)..(8): 2'-deoxy
  misc_feature (9)..(9): 2'-deoxy-2'-fluoro
  misc_feature (10)..(10): 2'-deoxy
  misc_feature (11)..(12): 2'-deoxy-2'-fluoro
  misc_feature (13)..(13): 2'-deoxy
  misc_feature (14)..(14): 2'-deoxy-2'-fluoro
  misc_feature (15)..(18): 2'-deoxy
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 246 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(9): 2'-O-methyl
  misc_feature (10)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (15)..(15): 2'-O-methyl
  misc_feature (16)..(17): 2'-deoxy-2'-fluoro
  misc_feature (18)..(21): 2'-O-methyl
  misc_feature (20)..(21): phosphorothioate linkage
guuccgcaguauggaucgguu

SEQ ID NO: 247 - RNA, 21 nt, Artificial Sequence
  Synthetic
  misc_feature (1)..(1): inverted abasic cap
  misc_feature (1)..(1): 2'-O-methyl
  misc_feature (4)..(5): 2'-O-methyl
  misc_feature (9)..(9): 2'-O-methyl
  misc_feature (11)..(11): 2'-O-methyl
  misc_feature (14)..(14): 2'-O-methyl
  misc_feature (16)..(21): 2'-O-methyl
  misc_feature (20)..(21): phosphorothioate linkage
  misc_feature (21)..(21): inverted abasic cap
gccgauccauacugcggaauu

SEQ ID NO: 248 - RNA, 21 nt, Artificial Sequence
  Synthetic
  misc_feature (5)..(5): 2'-O-methyl
  misc_feature (7)..(8): 2'-O-methyl
  misc_feature (10)..(10): 2'-O-methyl
  misc_feature (12)..(13): 2'-O-methyl
  misc_feature (17)..(18): 2'-O-methyl
  misc_feature (20)..(21): 2'-O-methyl
  misc_feature (20)..(21): phosphorothioate linkage
uuccgcaguauggaucggcuu

SEQ ID NO: 249 - RNA, 21 nt, Artificial Sequence
  Synthetic
  misc_feature (1)..(1): inverted abasic cap
  misc_feature (2)..(3): 2'-deoxy-2'-fluoro
  misc_feature (6)..(8): 2'-deoxy-2'-fluoro
  misc_feature (10)..(10): 2'-deoxy-2'-fluoro
  misc_feature (12)..(13): 2'-deoxy-2'-fluoro
  misc_feature (15)..(15): 2'-deoxy-2'-fluoro
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 250 - RNA, 21 nt, Artificial Sequence
  Synthetic
  misc_feature (1)..(1): inverted abasic cap
  misc_feature (2)..(2): 2'-O-methyl
  misc_feature (5)..(5): 2'-O-methyl
  misc_feature (9)..(16): 2'-O-methyl
  misc_feature (19)..(21): 2'-O-methyl
  misc_feature (20)..(21): phosphorothioate linkage
  misc_feature (21)..(21): inverted abasic cap
gugguggacuucucucaauuu

SEQ ID NO: 251 - RNA, 21 nt, Artificial Sequence
  Synthetic
  misc_feature (4)..(11): 2'-deoxy-2'-fluoro
  misc_feature (15)..(15): 2'-deoxy-2'-fluoro
  misc_feature (18)..(18): 2'-deoxy-2'-fluoro
  misc_feature (20)..(21): 2'-O-methyl
  misc_feature (20)..(21): phosphorothioate linkage
auugagagaaguccaccacuu

SEQ ID NO: 252 - RNA, 21 nt, Artificial Sequence
  Synthetic
  misc_feature (1)..(1): inverted abasic cap
  misc_feature (2)..(2): 2'-deoxy-2'-fluoro
  misc_feature (5)..(5): 2'-deoxy-2'-fluoro
  misc_feature (9)..(16): 2'-deoxy-2'-fluoro
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 253 - RNA, 21 nt, Artificial Sequence
  Synthetic
  misc_feature (1)..(1): inverted abasic cap
  misc_feature (1)..(2): 2'-deoxy-2'-fluoro
  misc_feature (4)..(4): 2'-deoxy-2'-fluoro
  misc_feature (7)..(7): 2'-deoxy-2'-fluoro
  misc_feature (11)..(18): 2'-deoxy-2'-fluoro
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 254 - RNA, 21 nt, Artificial Sequence
  Synthetic
  misc_feature (4)..(5): 2'-O-methyl
  misc_feature (7)..(7): 2'-O-methyl
  misc_feature (10)..(10): 2'-O-methyl
  misc_feature (12)..(12): 2'-O-methyl
  misc_feature (16)..(17): 2'-O-methyl
  misc_feature (20)..(21): 2'-O-methyl
  misc_feature (20)..(21): phosphorothioate linkage
guuccgcaguauggaucgguu

SEQ ID NO: 255 - RNA, 21 nt, Artificial Sequence
  Synthetic
  misc_feature (6)..(6): 2'-deoxy-2'-fluoro
  misc_feature (8)..(9): 2'-deoxy-2'-fluoro
  misc_feature (11)..(11): 2'-deoxy-2'-fluoro
  misc_feature (13)..(15): 2'-deoxy-2'-fluoro
  misc_feature (18)..(19): 2'-deoxy-2'-fluoro
  misc_feature (20)..(21): 2'-O-methyl
  misc_feature (20)..(21): phosphorothioate linkage
guuccgcaguauggaucgguu

SEQ ID NO: 256 - RNA, 21 nt, Artificial Sequence
  Synthetic
  misc_feature (12)..(13): 2'-O-methyl
  misc_feature (16)..(17): 2'-O-methyl
  misc_feature (19)..(21): 2'-O-methyl
  misc_feature (20)..(21): phosphorothioate linkage
auugagagaaguccaccacuu

SEQ ID NO: 257 - RNA, 21 nt, Artificial Sequence
  Synthetic
  misc_feature (1)..(1): inverted abasic cap
  misc_feature (1)..(1): 2'-O-methyl
  misc_feature (3)..(4): 2'-O-methyl
  misc_feature (6)..(8): 2'-O-methyl
  misc_feature (17)..(18): 2'-O-methyl
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 258 - RNA, 21 nt, Artificial Sequence
  Synthetic
  misc_feature (1)..(1): inverted abasic cap
  misc_feature (1)..(1): 2'-deoxy
  misc_feature (2)..(2): 2'-deoxy-2'-fluoro
  misc_feature (3)..(4): 2'-deoxy
  misc_feature (5)..(5): 2'-deoxy-2'-fluoro
  misc_feature (6)..(8): 2'-deoxy
  misc_feature (9)..(16): 2'-deoxy-2'-fluoro
  misc_feature (17)..(18): 2'-deoxy
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 259 - RNA, 21 nt, Artificial Sequence
  Synthetic
  misc_feature (4)..(11): 2'-O-methyl
  misc_feature (12)..(14): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
auugagagaaguccaccacuu

SEQ ID NO: 260 - RNA, 21 nt, Artificial Sequence
  Synthetic
  misc_feature (4)..(9): 2'-O-methyl
  misc_feature (13)..(13): 2'-O-methyl
  misc_feature (16)..(16): 2'-O-methyl
  misc_feature (18)..(21): 2'-O-methyl
  misc_feature (20)..(21): phosphorothioate linkage
ugagagaaguccaccacgauu

SEQ ID NO: 261 - RNA, 21 nt, Artificial Sequence
  Synthetic
  misc_feature (1)..(1): inverted abasic cap
  misc_feature (1)..(2): 2'-O-methyl
  misc_feature (5)..(7): 2'-O-methyl
  misc_feature (9)..(9): 2'-O-methyl
  misc_feature (11)..(12): 2'-O-methyl
  misc_feature (14)..(14): 2'-O-methyl
  misc_feature (19)..(21): 2'-O-methyl
  misc_feature (20)..(21): phosphorothioate linkage
  misc_feature (21)..(21): inverted abasic cap
ccgauccauacugcggaacuu

SEQ ID NO: 262 - RNA, 21 nt, Artificial Sequence
  Synthetic
  misc_feature (1)..(1): inverted abasic cap
  misc_feature (1)..(2): 2'-deoxy-2'-fluoro
  misc_feature (5)..(7): 2'-deoxy-2'-fluoro
  misc_feature (9)..(9): 2'-deoxy-2'-fluoro
  misc_feature (11)..(12): 2'-deoxy-2'-fluoro
  misc_feature (14)..(14): 2'-deoxy-2'-fluoro
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 263 - RNA, 21 nt, Artificial Sequence
  Synthetic
  misc_feature (4)..(11): 2'-deoxy-2'-fluoro
  misc_feature (12)..(13): 2'-O-methyl
  misc_feature (15)..(15): 2'-deoxy-2'-fluoro
  misc_feature (16)..(17): 2'-O-methyl
  misc_feature (18)..(18): 2'-deoxy-2'-fluoro
  misc_feature (19)..(21): 2'-O-methyl
  misc_feature (20)..(21): phosphorothioate linkage
auugagagaaguccaccacuu

SEQ ID NO: 264 - RNA, 21 nt, Artificial Sequence
  Synthetic
  misc_feature (1)..(1): inverted abasic cap
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 265 - RNA, 21 nt, Artificial Sequence
  Synthetic
  misc_feature (20)..(21): 2'-O-methyl
  misc_feature (20)..(21): phosphorothioate linkage
ugagagaaguccaccacgauu

SEQ ID NO: 266 - RNA, 21 nt, Artificial Sequence
  Synthetic
  misc_feature (4)..(5): 2'-O-methyl
  misc_feature (6)..(6): 2'-deoxy-2'-fluoro
  misc_feature (7)..(7): 2'-O-methyl
  misc_feature (8)..(9): 2'-deoxy-2'-fluoro
  misc_feature (10)..(10): 2'-O-methyl
  misc_feature (11)..(11): 2'-deoxy-2'-fluoro
  misc_feature (12)..(12): 2'-O-methyl
  misc_feature (13)..(15): 2'-deoxy-2'-fluoro
  misc_feature (16)..(17): 2'-O-methyl
  misc_feature (18)..(19): 2'-deoxy-2'-fluoro
  misc_feature (20)..(21): 2'-O-methyl
  misc_feature (20)..(21): phosphorothioate linkage
guuccgcaguauggaucgguu

SEQ ID NO: 267 - RNA, 21 nt, Artificial Sequence
  Synthetic
  misc_feature (4)..(4): 2'-O-methyl
  misc_feature (6)..(6): 2'-O-methyl
  misc_feature (9)..(9): 2'-O-methyl
  misc_feature (11)..(11): 2'-O-methyl
  misc_feature (15)..(16): 2'-O-methyl
  misc_feature (19)..(21): 2'-O-methyl
  misc_feature (20)..(21): phosphorothioate linkage
uuccgcaguauggaucggcuu

SEQ ID NO: 268 - RNA, 21 nt, Artificial Sequence
  Synthetic
  misc_feature (4)..(11): 2'-O-methyl
  misc_feature (15)..(15): 2'-O-methyl
  misc_feature (18)..(18): 2'-O-methyl
  misc_feature (20)..(21): 2'-O-methyl
  misc_feature (20)..(21): phosphorothioate linkage
auugagagaaguccaccacuu

SEQ ID NO: 269 - RNA, 21 nt, Artificial Sequence
  Synthetic
  misc_feature (1)..(1): inverted abasic cap
  misc_feature (1)..(2): 2'-deoxy-2'-fluoro
  misc_feature (3)..(3): 2'-deoxy
  misc_feature (4)..(4): 2'-deoxy-2'-fluoro
  misc_feature (5)..(6): 2'-deoxy
  misc_feature (7)..(7): 2'-deoxy-2'-fluoro
  misc_feature (8)..(10): 2'-deoxy
  misc_feature (11)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 270 - RNA, 21 nt, Artificial Sequence
  Synthetic
  misc_feature (1)..(1): inverted abasic cap
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 271 - RNA, 21 nt, Artificial Sequence
  Synthetic
  misc_feature (20)..(21): 2'-O-methyl
  misc_feature (20)..(21): phosphorothioate linkage
guuccgcaguauggaucgguu

SEQ ID NO: 272 - RNA, 21 nt, Artificial Sequence
  Synthetic
  misc_feature (1)..(1): inverted abasic cap
  misc_feature (1)..(5): 2'-deoxy
  misc_feature (6)..(6): 2'-O-methyl
  misc_feature (8)..(8): 2'-O-methyl
  misc_feature (9)..(9): 2'-deoxy
  misc_feature (10)..(10): 2'-deoxy-2'-fluoro
  misc_feature (11)..(12): 2'-deoxy
  misc_feature (13)..(13): 2'-deoxy-2'-fluoro
  misc_feature (14)..(14): 2'-deoxy
  misc_feature (15)..(16): 2'-deoxy-2'-fluoro
  misc_feature (17)..(19): 2'-deoxy
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 273 - RNA, 21 nt, Artificial Sequence
  Synthetic
  misc_feature (1)..(3): 2'-O-methyl
  misc_feature (4)..(4): 2'-deoxy-2'-fluoro
  misc_feature (5)..(5): 2'-O-methyl
  misc_feature (6)..(8): 2'-deoxy-2'-fluoro
  misc_feature (10)..(10): 2'-deoxy-2'-fluoro
  misc_feature (11)..(11): 2'-O-methyl
  misc_feature (13)..(14): 2'-deoxy-2'-fluoro
  misc_feature (15)..(15): 2'-O-methyl
  misc_feature (16)..(16): 2'-deoxy-2'-fluoro
  misc_feature (18)..(18): 2'-deoxy-2'-fluoro
  misc_feature (20)..(21): 2'-O-methyl
  misc_feature (20)..(21): phosphorothioate linkage
guuccgcaguauggaucgguu

SEQ ID NO: 274 - RNA, 21 nt, Artificial Sequence
  Synthetic
  misc_feature (1)..(1): inverted abasic cap
  misc_feature (1)..(1): 2'-deoxy
  misc_feature (3)..(3): 2'-deoxy-2'-fluoro
  misc_feature (4)..(4): 2'-deoxy
  misc_feature (5)..(5): 2'-O-methyl
  misc_feature (7)..(7): 2'-deoxy
  misc_feature (8)..(8): 2'-deoxy-2'-fluoro
  misc_feature (10)..(10): 2'-deoxy-2'-fluoro
  misc_feature (11)..(12): 2'-O-methyl
  misc_feature (13)..(14): 2'-deoxy-2'-fluoro
  misc_feature (15)..(15): 2'-deoxy
  misc_feature (16)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 275 - RNA, 21 nt, Artificial Sequence
  Synthetic
  misc_feature (1)..(1): 2'-O-methyl
  misc_feature (2)..(4): 2'-deoxy-2'-fluoro
  misc_feature (6)..(6): 2'-deoxy-2'-fluoro
  misc_feature (7)..(7): 2'-O-methyl
  misc_feature (9)..(9): 2'-deoxy-2'-fluoro
  misc_feature (11)..(13): 2'-O-methyl
  misc_feature (14)..(14): 2'-deoxy-2'-fluoro
  misc_feature (15)..(15): 2'-O-methyl
  misc_feature (17)..(17): 2'-O-methyl
  misc_feature (18)..(18): 2'-deoxy-2'-fluoro
  misc_feature (19)..(21): 2'-O-methyl
  misc_feature (20)..(21): phosphorothioate linkage
guuccgcaguauggaucgguu

SEQ ID NO: 276 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (5)..(6): 2'-deoxy-2'-fluoro
  misc_feature (7)..(7): 2'-O-methyl
  misc_feature (8)..(8): 2'-deoxy-2'-fluoro
  misc_feature (10)..(12): 2'-deoxy-2'-fluoro
  misc_feature (13)..(13): 2'-O-methyl
  misc_feature (14)..(15): 2'-deoxy-2'-fluoro
  misc_feature (17)..(17): 2'-deoxy-2'-fluoro
  misc_feature (19)..(21): 2'-O-methyl
  misc_feature (20)..(21): phosphorothioate linkage
guuccgcaguauggaucgguu

SEQ ID NO: 277 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-deoxy
  misc_feature (4)..(6): 2'-deoxy
  misc_feature (7)..(7): 2'-O-methyl
  misc_feature (8)..(9): 2'-deoxy-2'-fluoro
  misc_feature (10)..(10): 2'-O-methyl
  misc_feature (11)..(11): 2'-deoxy
  misc_feature (14)..(14): 2'-deoxy
  misc_feature (15)..(15): 2'-deoxy-2'-fluoro
  misc_feature (16)..(17): 2'-deoxy
  misc_feature (18)..(18): 2'-O-methyl
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 278 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(4): 2'-deoxy-2'-fluoro
  misc_feature (5)..(6): 2'-O-methyl
  misc_feature (8)..(8): 2'-O-methyl
  misc_feature (9)..(10): 2'-deoxy-2'-fluoro
  misc_feature (12)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (17)..(17): 2'-deoxy-2'-fluoro
  misc_feature (18)..(21): 2'-O-methyl
  misc_feature (20)..(21): phosphorothioate linkage
uuccgcaguauggaucggcuu

SEQ ID NO: 279 - RNA, 21 nt, Artificial Sequence
  Synthetic
  misc_feature (1)..(1): inverted abasic cap
  misc_feature (1)..(1): 2'-deoxy
  misc_feature (3)..(3): 2'-deoxy
  misc_feature (4)..(5): 2'-deoxy-2'-fluoro
  misc_feature (6)..(7): 2'-O-methyl
  misc_feature (8)..(8): 2'-deoxy
  misc_feature (9)..(9): 2'-deoxy-2'-fluoro
  misc_feature (10)..(10): 2'-O-methyl
  misc_feature (11)..(11): 2'-deoxy
  misc_feature (14)..(15): 2'-deoxy
  misc_feature (16)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 280 - RNA, 21 nt, Artificial Sequence
  Synthetic
  misc_feature (1)..(1): inverted abasic cap
  misc_feature (1)..(1): 2'-O-methyl
  misc_feature (3)..(3): 2'-deoxy
  misc_feature (5)..(5): 2'-O-methyl
  misc_feature (6)..(6): 2'-deoxy
  misc_feature (7)..(7): 2'-deoxy-2'-fluoro
  misc_feature (8)..(8): 2'-deoxy
  misc_feature (9)..(9): 2'-O-methyl
  misc_feature (10)..(11): 2'-deoxy
  misc_feature (12)..(12): 2'-deoxy-2'-fluoro
  misc_feature (13)..(13): 2'-O-methyl
  misc_feature (14)..(15): 2'-deoxy
  misc_feature (16)..(18): 2'-O-methyl
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 281 - RNA, 21 nt, Artificial Sequence
  Synthetic
  misc_feature (1)..(1): 2'-O-methyl
  misc_feature (2)..(4): 2'-deoxy-2'-fluoro
  misc_feature (5)..(5): 2'-O-methyl
  misc_feature (6)..(6): 2'-deoxy-2'-fluoro
  misc_feature (7)..(7): 2'-O-methyl
  misc_feature (8)..(8): 2'-deoxy-2'-fluoro
  misc_feature (11)..(11): 2'-deoxy-2'-fluoro
  misc_feature (12)..(12): 2'-O-methyl
  misc_feature (14)..(14): 2'-deoxy-2'-fluoro
  misc_feature (15)..(16): 2'-O-methyl
  misc_feature (18)..(21): 2'-O-methyl
  misc_feature (20)..(21): phosphorothioate linkage
auugagagaaguccaccacuu

SEQ ID NO: 282 - RNA, 21 nt, Artificial Sequence
  Synthetic
  misc_feature (1)..(1): 2'-deoxy-2'-fluoro
  misc_feature (2)..(3): 2'-O-methyl
  misc_feature (4)..(4): 2'-deoxy-2'-fluoro
  misc_feature (6)..(7): 2'-O-methyl
  misc_feature (8)..(8): 2'-deoxy-2'-fluoro
  misc_feature (9)..(9): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(16): 2'-O-methyl
  misc_feature (17)..(18): 2'-deoxy-2'-fluoro
  misc_feature (20)..(21): 2'-O-methyl
  misc_feature (20)..(21): phosphorothioate linkage
auugagagaaguccaccacuu

SEQ ID NO: 283 - RNA, 21 nt, Artificial Sequence
  Synthetic
  misc_feature (1)..(1): inverted abasic cap
  misc_feature (1)..(3): 2'-deoxy
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(7): 2'-deoxy
  misc_feature (8)..(8): 2'-deoxy-2'-fluoro
  misc_feature (9)..(9): 2'-deoxy
  misc_feature (11)..(15): 2'-deoxy
  misc_feature (17)..(18): 2'-deoxy
  misc_feature (19)..(21): 2'-O-methyl
  misc_feature (20)..(21): phosphorothioate linkage
  misc_feature (21)..(21): inverted abasic cap
gugguggacuucucucaauuu

SEQ ID NO: 284 - RNA, 21 nt, Artificial Sequence
  Synthetic
  misc_feature (1)..(1): inverted abasic cap
  misc_feature (1)..(1): 2'-deoxy
  misc_feature (3)..(3): 2'-deoxy
  misc_feature (4)..(4): 2'-deoxy-2'-fluoro
  misc_feature (5)..(6): 2'-deoxy
  misc_feature (7)..(8): 2'-deoxy-2'-fluoro
  misc_feature (9)..(9): 2'-O-methyl
  misc_feature (10)..(10): 2'-deoxy
  misc_feature (11)..(11): 2'-O-methyl
  misc_feature (13)..(16): 2'-deoxy
  misc_feature (17)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 285 - RNA, 21 nt, Artificial Sequence
  Synthetic
  misc_feature (1)..(2): 2'-O-methyl
  misc_feature (3)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (17)..(17): 2'-O-methyl
  misc_feature (19)..(21): 2'-O-methyl
  misc_feature (20)..(21): phosphorothioate linkage
auugagagaaguccaccacuu

SEQ ID NO: 286 - RNA, 21 nt, Artificial Sequence
  Synthetic
  misc_feature (1)..(1): inverted abasic cap
  misc_feature (1)..(1): 2'-deoxy
  misc_feature (3)..(3): 2'-deoxy
  misc_feature (4)..(4): 2'-O-methyl
  misc_feature (5)..(7): 2'-deoxy
  misc_feature (8)..(10): 2'-deoxy-2'-fluoro
  misc_feature (11)..(11): 2'-O-methyl
  misc_feature (12)..(12): 2'-deoxy-2'-fluoro
  misc_feature (13)..(14): 2'-deoxy
  misc_feature (17)..(17): 2'-O-methyl
  misc_feature (18)..(18): 2'-deoxy
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 287 - RNA, 21 nt, Artificial Sequence
  Synthetic
  misc_feature (1)..(2): 2'-O-methyl
  misc_feature (3)..(3): 2'-deoxy-2'-fluoro
  misc_feature (5)..(6): 2'-O-methyl
  misc_feature (8)..(8): 2'-deoxy-2'-fluoro
  misc_feature (10)..(10): 2'-O-methyl
  misc_feature (11)..(11): 2'-deoxy-2'-fluoro
  misc_feature (13)..(14): 2'-deoxy-2'-fluoro
  misc_feature (15)..(15): 2'-O-methyl
  misc_feature (16)..(16): 2'-deoxy-2'-fluoro
  misc_feature (18)..(18): 2'-deoxy-2'-fluoro
  misc_feature (19)..(21): 2'-O-methyl
  misc_feature (20)..(21): phosphorothioate linkage
ugagagaaguccaccacgauu

SEQ ID NO: 288 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(5): 2'-deoxy-2'-fluoro
  misc_feature (6)..(6): 2'-O-methyl
  misc_feature (9)..(9): 2'-deoxy-2'-fluoro
  misc_feature (10)..(10): 2'-O-methyl
  misc_feature (11)..(11): 2'-deoxy-2'-fluoro
  misc_feature (13)..(13): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
  misc_feature (20)..(21): phosphorothioate linkage
guuccgcaguauggaucgguu

SEQ ID NO: 289 - RNA, 21 nt, Artificial Sequence
  Synthetic
  misc_feature (1)..(1): inverted abasic cap
  misc_feature (1)..(1): 2'-O-methyl
  misc_feature (2)..(3): 2'-deoxy
  misc_feature (4)..(4): 2'-deoxy-2'-fluoro
  misc_feature (5)..(5): 2'-deoxy
  misc_feature (6)..(6): 2'-O-methyl
  misc_feature (7)..(8): 2'-deoxy
  misc_feature (10)..(10): 2'-deoxy-2'-fluoro
  misc_feature (12)..(12): 2'-deoxy-2'-fluoro
  misc_feature (13)..(13): 2'-O-methyl
  misc_feature (15)..(15): 2'-O-methyl
  misc_feature (16)..(16): 2'-deoxy-2'-fluoro
  misc_feature (18)..(18): 2'-deoxy
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 290 - RNA, 21 nt, Artificial Sequence
  Synthetic
  misc_feature (1)..(1): 2'-deoxy-2'-fluoro
  misc_feature (2)..(3): 2'-O-methyl
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(7): 2'-O-methyl
  misc_feature (8)..(8): 2'-deoxy-2'-fluoro
  misc_feature (11)..(11): 2'-O-methyl
  misc_feature (13)..(13): 2'-deoxy-2'-fluoro
  misc_feature (15)..(15): 2'-O-methyl
  misc_feature (16)..(18): 2'-deoxy-2'-fluoro
  misc_feature (20)..(21): 2'-O-methyl
  misc_feature (20)..(21): phosphorothioate linkage
uuccgcaguauggaucggcuu

SEQ ID NO: 291 - RNA, 21 nt, Artificial Sequence
  Synthetic
  misc_feature (1)..(1): inverted abasic cap
  misc_feature (1)..(1): 2'-deoxy
  misc_feature (2)..(2): 2'-O-methyl
  misc_feature (4)..(4): 2'-O-methyl
  misc_feature (6)..(6): 2'-deoxy-2'-fluoro
  misc_feature (8)..(8): 2'-deoxy
  misc_feature (10)..(10): 2'-O-methyl
  misc_feature (11)..(11): 2'-deoxy-2'-fluoro
  misc_feature (12)..(12): 2'-deoxy
  misc_feature (13)..(13): 2'-deoxy-2'-fluoro
  misc_feature (14)..(15): 2'-deoxy
  misc_feature (16)..(16): 2'-deoxy-2'-fluoro
  misc_feature (17)..(17): 2'-deoxy
  misc_feature (18)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 292 - RNA, 21 nt, Artificial Sequence
  Synthetic
  misc_feature (1)..(1): 2'-deoxy-2'-fluoro
  misc_feature (2)..(3): 2'-O-methyl
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (12)..(13): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (20)..(21): 2'-O-methyl
  misc_feature (20)..(21): phosphorothioate linkage
uuccgcaguauggaucggcuu

SEQ ID NO: 293 - RNA, 21 nt, Artificial Sequence
  Synthetic
  misc_feature (1)..(1): inverted abasic cap
  misc_feature (1)..(2): 2'-deoxy-2'-fluoro
  misc_feature (4)..(4): 2'-deoxy
  misc_feature (5)..(6): 2'-O-methyl
  misc_feature (7)..(7): 2'-deoxy
  misc_feature (8)..(8): 2'-O-methyl
  misc_feature (9)..(9): 2'-deoxy
  misc_feature (10)..(11): 2'-O-methyl
  misc_feature (12)..(12): 2'-deoxy
  misc_feature (14)..(14): 2'-deoxy
  misc_feature (15)..(15): 2'-O-methyl
  misc_feature (17)..(18): 2'-deoxy
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 294 - RNA, 21 nt, Artificial Sequence
  Synthetic
  misc_feature (1)..(1): inverted abasic cap
  misc_feature (1)..(1): 2'-deoxy
  misc_feature (2)..(2): 2'-deoxy-2'-fluoro
  misc_feature (3)..(3): 2'-deoxy
  misc_feature (5)..(5): 2'-O-methyl
  misc_feature (6)..(9): 2'-deoxy
  misc_feature (12)..(12): 2'-O-methyl
  misc_feature (13)..(13): 2'-deoxy
  misc_feature (14)..(16): 2'-O-methyl
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 295 - RNA, 21 nt, Artificial Sequence
  Synthetic
  misc_feature (1)..(3): 2'-O-methyl
  misc_feature (4)..(4): 2'-deoxy-2'-fluoro
  misc_feature (7)..(8): 2'-deoxy-2'-fluoro
  misc_feature (9)..(9): 2'-O-methyl
  misc_feature (10)..(10): 2'-deoxy-2'-fluoro
  misc_feature (11)..(11): 2'-O-methyl
  misc_feature (12)..(12): 2'-deoxy-2'-fluoro
  misc_feature (15)..(15): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
uuccgcaguauggaucggcuu

SEQ ID NO: 296 - RNA, 21 nt, Artificial Sequence
  Synthetic
  misc_feature (1)..(1): inverted abasic cap
  misc_feature (1)..(1): 2'-deoxy
  misc_feature (3)..(3): 2'-deoxy-2'-fluoro
  misc_feature (4)..(6): 2'-deoxy
  misc_feature (7)..(7): 2'-O-methyl
  misc_feature (8)..(8): 2'-deoxy-2'-fluoro
  misc_feature (9)..(9): 2'-O-methyl
  misc_feature (11)..(11): 2'-deoxy
  misc_feature (12)..(13): 2'-O-methyl
  misc_feature (14)..(14): 2'-deoxy
  misc_feature (16)..(18): 2'-deoxy-2'-fluoro
  misc_feature (19)..(21): 2'-O-methyl
  misc_feature (20)..(21): phosphorothioate linkage
  misc_feature (21)..(21): inverted abasic cap
gugguggacuucucucaauuu

SEQ ID NO: 297 - RNA, 21 nt, Artificial Sequence
  Synthetic
  misc_feature (1)..(1): 2'-O-methyl
  misc_feature (2)..(2): 2'-deoxy-2'-fluoro
  misc_feature (3)..(4): 2'-O-methyl
  misc_feature (5)..(5): 2'-deoxy-2'-fluoro
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (11)..(11): 2'-deoxy-2'-fluoro
  misc_feature (12)..(12): 2'-O-methyl
  misc_feature (13)..(13): 2'-deoxy-2'-fluoro
  misc_feature (15)..(15): 2'-O-methyl
  misc_feature (17)..(19): 2'-deoxy-2'-fluoro
  misc_feature (20)..(21): 2'-O-methyl
  misc_feature (20)..(21): phosphorothioate linkage
auugagagaaguccaccacuu

SEQ ID NO: 298 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (5)..(5): 2'-O-methyl
  misc_feature (7)..(7): 2'-O-methyl
  misc_feature (8)..(9): 2'-deoxy-2'-fluoro
  misc_feature (10)..(10): 2'-O-methyl
  misc_feature (11)..(11): 2'-deoxy-2'-fluoro
  misc_feature (13)..(14): 2'-deoxy-2'-fluoro
  misc_feature (17)..(17): 2'-O-methyl
  misc_feature (19)..(21): 2'-O-methyl
  misc_feature (20)..(21): phosphorothioate linkage
auugagagaaguccaccacuu

SEQ ID NO: 299 - RNA, 21 nt, Artificial Sequence
  Synthetic
  misc_feature (1)..(1): inverted abasic cap
  misc_feature (1)..(1): 2'-deoxy
  misc_feature (3)..(3): 2'-O-methyl
  misc_feature (4)..(5): 2'-deoxy
  misc_feature (6)..(7): 2'-deoxy-2'-fluoro
  misc_feature (8)..(9): 2'-deoxy
  misc_feature (10)..(10): 2'-O-methyl
  misc_feature (11)..(11): 2'-deoxy-2'-fluoro
  misc_feature (13)..(13): 2'-O-methyl
  misc_feature (14)..(14): 2'-deoxy
  misc_feature (15)..(17): 2'-O-methyl
  misc_feature (18)..(19): 2'-deoxy
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 300 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-O-methyl
  misc_feature (3)..(3): 2'-deoxy
  misc_feature (4)..(4): 2'-O-methyl
  misc_feature (6)..(6): 2'-deoxy
  misc_feature (7)..(7): 2'-O-methyl
  misc_feature (9)..(9): 2'-deoxy
  misc_feature (10)..(10): 2'-O-methyl
  misc_feature (11)..(11): 2'-deoxy
  misc_feature (12)..(12): 2'-O-methyl
  misc_feature (13)..(13): 2'-deoxy
  misc_feature (14)..(14): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 301 - RNA, 21 nt, Artificial Sequence
  Synthetic
  misc_feature (1)..(2): 2'-O-methyl
  misc_feature (3)..(3): 2'-deoxy-2'-fluoro
  misc_feature (4)..(5): 2'-O-methyl
  misc_feature (8)..(9): 2'-O-methyl
  misc_feature (11)..(11): 2'-deoxy-2'-fluoro
  misc_feature (12)..(12): 2'-O-methyl
  misc_feature (16)..(16): 2'-deoxy-2'-fluoro
  misc_feature (17)..(17): 2'-O-methyl
  misc_feature (18)..(18): 2'-deoxy-2'-fluoro
  misc_feature (20)..(21): 2'-O-methyl
  misc_feature (20)..(21): phosphorothioate linkage
auugagagaaguccaccacuu

SEQ ID NO: 302 - RNA, 21 nt, Artificial Sequence
  Synthetic
  misc_feature (1)..(1): inverted abasic cap
  misc_feature (1)..(1): 2'-O-methyl
  misc_feature (2)..(2): 2'-deoxy
  misc_feature (3)..(3): 2'-deoxy-2'-fluoro
  misc_feature (4)..(6): 2'-deoxy
  misc_feature (8)..(9): 2'-O-methyl
  misc_feature (10)..(10): 2'-deoxy-2'-fluoro
  misc_feature (12)..(13): 2'-deoxy
  misc_feature (14)..(14): 2'-O-methyl
  misc_feature (15)..(15): 2'-deoxy-2'-fluoro
  misc_feature (16)..(17): 2'-O-methyl
  misc_feature (18)..(19): 2'-deoxy
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 303 - RNA, 21 nt, Artificial Sequence
  Synthetic
  misc_feature (1)..(2): 2'-O-methyl
  misc_feature (3)..(3): 2'-deoxy-2'-fluoro
  misc_feature (5)..(6): 2'-deoxy-2'-fluoro
  misc_feature (8)..(8): 2'-O-methyl
  misc_feature (9)..(12): 2'-deoxy-2'-fluoro
  misc_feature (14)..(14): 2'-deoxy-2'-fluoro
  misc_feature (16)..(17): 2'-O-methyl
  misc_feature (18)..(19): 2'-deoxy-2'-fluoro
  misc_feature (20)..(21): 2'-O-methyl
  misc_feature (20)..(21): phosphorothioate linkage
ugagagaaguccaccacgauu

SEQ ID NO: 304 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (4)..(4): 2'-O-methyl
  misc_feature (6)..(6): 2'-O-methyl
  misc_feature (7)..(7): 2'-deoxy-2'-fluoro
  misc_feature (8)..(8): 2'-O-methyl
  misc_feature (9)..(10): 2'-deoxy-2'-fluoro
  misc_feature (12)..(14): 2'-deoxy-2'-fluoro
  misc_feature (15)..(15): 2'-O-methyl
  misc_feature (17)..(17): 2'-O-methyl
  misc_feature (18)..(18): 2'-deoxy-2'-fluoro
  misc_feature (19)..(21): 2'-O-methyl
  misc_feature (20)..(21): phosphorothioate linkage
ugagagaaguccaccacgauu

SEQ ID NO: 305 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-O-methyl
  misc_feature (3)..(4): 2'-deoxy
  misc_feature (5)..(8): 2'-deoxy-2'-fluoro
  misc_feature (9)..(9): 2'-deoxy
  misc_feature (12)..(13): 2'-deoxy
  misc_feature (14)..(14): 2'-O-methyl
  misc_feature (16)..(16): 2'-deoxy
  misc_feature (17)..(17): 2'-deoxy-2'-fluoro
  misc_feature (18)..(21): 2'-O-methyl
  misc_feature (20)..(21): phosphorothioate linkage
  misc_feature (21)..(21): inverted abasic cap
ucgugguggacuucucucauu

SEQ ID NO: 306 - RNA, 21 nt, Artificial Sequence
  Synthetic
  misc_feature (1)..(2): 2'-deoxy-2'-fluoro
  misc_feature (3)..(4): 2'-O-methyl
  misc_feature (5)..(5): 2'-deoxy-2'-fluoro
  misc_feature (7)..(7): 2'-O-methyl
  misc_feature (8)..(8): 2'-deoxy-2'-fluoro
  misc_feature (10)..(11): 2'-O-methyl
  misc_feature (12)..(13): 2'-deoxy-2'-fluoro
  misc_feature (15)..(16): 2'-deoxy-2'-fluoro
  misc_feature (18)..(21): 2'-O-methyl
  misc_feature (20)..(21): phosphorothioate linkage
ugagagaaguccaccacgauu

SEQ ID NO: 307 - RNA, 21 nt, Artificial Sequence
  Synthetic
  misc_feature (1)..(1): inverted abasic cap
  misc_feature (1)..(3): 2'-O-methyl
  misc_feature (4)..(6): 2'-deoxy-2'-fluoro
  misc_feature (8)..(8): 2'-deoxy
  misc_feature (9)..(10): 2'-deoxy-2'-fluoro
  misc_feature (11)..(12): 2'-O-methyl
  misc_feature (13)..(13): 2'-deoxy
  misc_feature (15)..(16): 2'-deoxy-2'-fluoro
  misc_feature (18)..(19): 2'-deoxy
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 308 - RNA, 21 nt, Artificial Sequence
  Synthetic
  misc_feature (1)..(1): inverted abasic cap
  misc_feature (1)..(1): 2'-O-methyl
  misc_feature (2)..(2): 2'-deoxy-2'-fluoro
  misc_feature (3)..(3): 2'-O-methyl
  misc_feature (4)..(5): 2'-deoxy
  misc_feature (7)..(8): 2'-O-methyl
  misc_feature (10)..(12): 2'-deoxy
  misc_feature (13)..(14): 2'-deoxy-2'-fluoro
  misc_feature (15)..(15): 2'-deoxy
  misc_feature (16)..(17): 2'-deoxy-2'-fluoro
  misc_feature (19)..(21): 2'-O-methyl
  misc_feature (20)..(21): phosphorothioate linkage
  misc_feature (21)..(21): inverted abasic cap
ccgauccauacugcggaacuu

SEQ ID NO: 309 - RNA, 21 nt, Artificial Sequence
  Synthetic
  misc_feature (1)..(1): 2'-O-methyl
  misc_feature (2)..(3): 2'-deoxy-2'-fluoro
  misc_feature (4)..(4): 2'-O-methyl
  misc_feature (5)..(5): 2'-deoxy-2'-fluoro
  misc_feature (6)..(6): 2'-O-methyl
  misc_feature (8)..(8): 2'-deoxy-2'-fluoro
  misc_feature (9)..(9): 2'-O-methyl
  misc_feature (11)..(13): 2'-O-methyl
  misc_feature (14)..(16): 2'-deoxy-2'-fluoro
  misc_feature (20)..(21): 2'-O-methyl
  misc_feature (20)..(21): phosphorothioate linkage
guuccgcaguauggaucgguu

SEQ ID NO: 310 - RNA, 21 nt, Artificial Sequence
  Synthetic
  misc_feature (1)..(1): inverted abasic cap
  misc_feature (1)..(1): 2'-deoxy
  misc_feature (2)..(2): 2'-O-methyl
  misc_feature (3)..(3): 2'-deoxy
  misc_feature (4)..(4): 2'-O-methyl
  misc_feature (7)..(7): 2'-deoxy
  misc_feature (9)..(9): 2'-O-methyl
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(14): 2'-deoxy
  misc_feature (15)..(16): 2'-O-methyl
  misc_feature (17)..(17): 2'-deoxy
  misc_feature (18)..(18): 2'-deoxy-2'-fluoro
  misc_feature (19)..(21): 2'-O-methyl
  misc_feature (20)..(21): phosphorothioate linkage
  misc_feature (21)..(21): inverted abasic cap
ccgauccauacugcggaacuu

SEQ ID NO: 311 - RNA, 21 nt, Artificial Sequence
  Synthetic
  misc_feature (1)..(4): 2'-O-methyl
  misc_feature (8)..(8): 2'-O-methyl
  misc_feature (10)..(10): 2'-O-methyl
  misc_feature (12)..(12): 2'-O-methyl
  misc_feature (13)..(13): 2'-deoxy-2'-fluoro
  misc_feature (15)..(16): 2'-O-methyl
  misc_feature (17)..(18): 2'-deoxy-2'-fluoro
  misc_feature (19)..(21): 2'-O-methyl
  misc_feature (20)..(21): phosphorothioate linkage
guuccgcaguauggaucgguu

SEQ ID NO: 312 - RNA, 21 nt, Artificial Sequence
  Synthetic
  misc_feature (1)..(1): inverted abasic cap
  misc_feature (2)..(2): 2'-deoxy
  misc_feature (3)..(3): 2'-O-methyl
  misc_feature (4)..(4): 2'-deoxy
  misc_feature (5)..(6): 2'-O-methyl
  misc_feature (8)..(11): 2'-deoxy
  misc_feature (13)..(13): 2'-deoxy
  misc_feature (14)..(15): 2'-O-methyl
  misc_feature (16)..(16): 2'-deoxy
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 313 - RNA, 21 nt, Artificial Sequence
  Synthetic
  misc_feature (1)..(3): 2'-O-methyl
  misc_feature (4)..(4): 2'-deoxy-2'-fluoro
  misc_feature (5)..(5): 2'-O-methyl
  misc_feature (7)..(7): 2'-O-methyl
  misc_feature (8)..(9): 2'-deoxy-2'-fluoro
  misc_feature (11)..(13): 2'-deoxy-2'-fluoro
  misc_feature (15)..(15): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
guuccgcaguauggaucgguu

SEQ ID NO: 314 - RNA, 21 nt, Artificial Sequence
  Synthetic
  misc_feature (1)..(1): 2'-deoxy-2'-fluoro
  misc_feature (2)..(4): 2'-O-methyl
  misc_feature (5)..(6): 2'-deoxy-2'-fluoro
  misc_feature (7)..(7): 2'-O-methyl
  misc_feature (11)..(11): 2'-deoxy-2'-fluoro
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(21): 2'-O-methyl
  misc_feature (20)..(21): phosphorothioate linkage
guuccgcaguauggaucgguu

SEQ ID NO: 315 - RNA, 21 nt, Artificial Sequence
  Synthetic
  misc_feature (1)..(1): inverted abasic cap
  misc_feature (1)..(1): 2'-O-methyl
  misc_feature (3)..(3): 2'-deoxy
  misc_feature (4)..(4): 2'-deoxy-2'-fluoro
  misc_feature (5)..(9): 2'-deoxy
  misc_feature (10)..(11): 2'-O-methyl
  misc_feature (13)..(13): 2'-deoxy
  misc_feature (14)..(14): 2'-O-methyl
  misc_feature (15)..(17): 2'-deoxy-2'-fluoro
  misc_feature (18)..(18): 2'-deoxy
  misc_feature (19)..(21): 2'-O-methyl
  misc_feature (20)..(21): phosphorothioate linkage
  misc_feature (21)..(21): inverted abasic cap
ccgauccauacugcggaacuu

SEQ ID NO: 316 - RNA, 21 nt, Artificial Sequence
  Synthetic
  misc_feature (1)..(1): inverted abasic cap
  misc_feature (1)..(2): 2'-deoxy
  misc_feature (3)..(3): 2'-O-methyl
  misc_feature (4)..(5): 2'-deoxy-2'-fluoro
  misc_feature (6)..(13): 2'-deoxy
  misc_feature (14)..(14): 2'-deoxy-2'-fluoro
  misc_feature (16)..(16): 2'-O-methyl
  misc_feature (17)..(17): 2'-deoxy
  misc_feature (18)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 317 - RNA, 21 nt, Artificial Sequence
  Synthetic
  misc_feature (1)..(4): 2'-O-methyl
  misc_feature (5)..(6): 2'-deoxy-2'-fluoro
  misc_feature (7)..(8): 2'-O-methyl
  misc_feature (10)..(10): 2'-deoxy-2'-fluoro
  misc_feature (11)..(11): 2'-O-methyl
  misc_feature (12)..(15): 2'-deoxy-2'-fluoro
  misc_feature (16)..(16): 2'-O-methyl
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
uuccgcaguauggaucggcuu

SEQ ID NO: 318 - RNA, 21 nt, Artificial Sequence
  Synthetic
  misc_feature (1)..(2): 2'-deoxy-2'-fluoro
  misc_feature (3)..(3): 2'-O-methyl
  misc_feature (4)..(4): 2'-deoxy-2'-fluoro
  misc_feature (5)..(6): 2'-O-methyl
  misc_feature (10)..(10): 2'-deoxy-2'-fluoro
  misc_feature (11)..(11): 2'-O-methyl
  misc_feature (13)..(16): 2'-deoxy-2'-fluoro
  misc_feature (18)..(18): 2'-deoxy-2'-fluoro
  misc_feature (19)..(21): 2'-O-methyl
  misc_feature (20)..(21): phosphorothioate linkage
auugagagaaguccaccacuu

SEQ ID NO: 319 - RNA, 21 nt, Artificial Sequence
  Synthetic
  misc_feature (1)..(1): inverted abasic cap
  misc_feature (1)..(2): 2'-deoxy
  misc_feature (3)..(4): 2'-deoxy-2'-fluoro
  misc_feature (5)..(5): 2'-O-methyl
  misc_feature (6)..(7): 2'-deoxy-2'-fluoro
  misc_feature (8)..(8): 2'-deoxy
  misc_feature (9)..(11): 2'-O-methyl
  misc_feature (13)..(13): 2'-deoxy-2'-fluoro
  misc_feature (15)..(15): 2'-deoxy-2'-fluoro
  misc_feature (17)..(18): 2'-deoxy-2'-fluoro
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 320 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(5): 2'-deoxy
  misc_feature (6)..(8): 2'-deoxy-2'-fluoro
  misc_feature (9)..(16): 2'-deoxy
  misc_feature (17)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 321 - RNA, 21 nt, Artificial Sequence
  Synthetic
  misc_feature (1)..(5): 2'-O-methyl
  misc_feature (6)..(6): 2'-deoxy-2'-fluoro
  misc_feature (8)..(10): 2'-deoxy-2'-fluoro
  misc_feature (12)..(12): 2'-O-methyl
  misc_feature (13)..(16): 2'-deoxy-2'-fluoro
  misc_feature (17)..(21): 2'-O-methyl
  misc_feature (20)..(21): phosphorothioate linkage
auugagagaaguccaccacuu

SEQ ID NO: 322 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-deoxy
  misc_feature (3)..(3): 2'-O-methyl
  misc_feature (4)..(4): 2'-deoxy
  misc_feature (5)..(5): 2'-O-methyl
  misc_feature (6)..(6): 2'-deoxy
  misc_feature (7)..(7): 2'-O-methyl
  misc_feature (8)..(8): 2'-deoxy-2'-fluoro
  misc_feature (9)..(10): 2'-deoxy
  misc_feature (12)..(12): 2'-O-methyl
  misc_feature (13)..(13): 2'-deoxy
  misc_feature (14)..(14): 2'-O-methyl
  misc_feature (15)..(15): 2'-deoxy
  misc_feature (16)..(16): 2'-O-methyl
  misc_feature (17)..(17): 2'-deoxy
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 323 - RNA, 21 nt, Artificial Sequence
  Synthetic
  misc_feature (1)..(1): 2'-O-methyl
  misc_feature (2)..(3): 2'-deoxy-2'-fluoro
  misc_feature (4)..(5): 2'-O-methyl
  misc_feature (6)..(7): 2'-deoxy-2'-fluoro
  misc_feature (9)..(9): 2'-O-methyl
  misc_feature (10)..(10): 2'-deoxy-2'-fluoro
  misc_feature (11)..(13): 2'-O-methyl
  misc_feature (14)..(14): 2'-deoxy-2'-fluoro
  misc_feature (16)..(16): 2'-O-methyl
  misc_feature (18)..(18): 2'-deoxy-2'-fluoro
  misc_feature (19)..(21): 2'-O-methyl
  misc_feature (20)..(21): phosphorothioate linkage
auugagagaaguccaccacuu

SEQ ID NO: 324 - RNA, 21 nt, Artificial Sequence
  Synthetic
  misc_feature (1)..(1): inverted abasic cap
  misc_feature (1)..(1): 2'-deoxy
  misc_feature (2)..(2): 2'-O-methyl
  misc_feature (3)..(4): 2'-deoxy-2'-fluoro
  misc_feature (6)..(6): 2'-O-methyl
  misc_feature (8)..(8): 2'-deoxy
  misc_feature (9)..(11): 2'-deoxy-2'-fluoro
  misc_feature (13)..(17): 2'-deoxy-2'-fluoro
  misc_feature (18)..(21): 2'-O-methyl
  misc_feature (20)..(21): phosphorothioate linkage
  misc_feature (21)..(21): inverted abasic cap
ccgauccauacugcggaacuu

SEQ ID NO: 325 - RNA, 21 nt, Artificial Sequence
  Synthetic
  misc_feature (1)..(2): 2'-O-methyl
  misc_feature (3)..(3): 2'-deoxy-2'-fluoro
  misc_feature (5)..(5): 2'-O-methyl
  misc_feature (7)..(7): 2'-deoxy-2'-fluoro
  misc_feature (8)..(8): 2'-O-methyl
  misc_feature (10)..(10): 2'-O-methyl
  misc_feature (11)..(11): 2'-deoxy-2'-fluoro
  misc_feature (13)..(13): 2'-O-methyl
  misc_feature (14)..(16): 2'-deoxy-2'-fluoro
  misc_feature (18)..(19): 2'-deoxy-2'-fluoro
  misc_feature (20)..(21): 2'-O-methyl
  misc_feature (20)..(21): phosphorothioate linkage
guuccgcaguauggaucgguu

SEQ ID NO: 326 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(3): 2'-deoxy
  misc_feature (4)..(5): 2'-deoxy-2'-fluoro
  misc_feature (6)..(8): 2'-deoxy
  misc_feature (9)..(9): 2'-deoxy-2'-fluoro
  misc_feature (10)..(10): 2'-deoxy
  misc_feature (11)..(11): 2'-deoxy-2'-fluoro
  misc_feature (12)..(13): 2'-deoxy
  misc_feature (14)..(14): 2'-deoxy-2'-fluoro
  misc_feature (15)..(15): 2'-deoxy
  misc_feature (16)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 327 - RNA, 21 nt, Artificial Sequence
  Synthetic
  misc_feature (1)..(3): 2'-O-methyl
  misc_feature (4)..(4): 2'-deoxy-2'-fluoro
  misc_feature (5)..(6): 2'-O-methyl
  misc_feature (7)..(8): 2'-deoxy-2'-fluoro
  misc_feature (9)..(10): 2'-O-methyl
  misc_feature (11)..(11): 2'-deoxy-2'-fluoro
  misc_feature (13)..(13): 2'-O-methyl
  misc_feature (14)..(14): 2'-deoxy-2'-fluoro
  misc_feature (16)..(16): 2'-deoxy-2'-fluoro
  misc_feature (17)..(17): 2'-O-methyl
  misc_feature (18)..(18): 2'-deoxy-2'-fluoro
  misc_feature (19)..(21): 2'-O-methyl
  misc_feature (20)..(21): phosphorothioate linkage
uuccgcaguauggaucggcuu

SEQ ID NO: 328 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (4)..(4): 2'-O-methyl
  misc_feature (5)..(5): 2'-deoxy-2'-fluoro
  misc_feature (6)..(9): 2'-O-methyl
  misc_feature (11)..(11): 2'-deoxy-2'-fluoro
  misc_feature (12)..(12): 2'-O-methyl
  misc_feature (14)..(14): 2'-deoxy-2'-fluoro
  misc_feature (15)..(15): 2'-O-methyl
  misc_feature (17)..(17): 2'-O-methyl
  misc_feature (18)..(18): 2'-deoxy-2'-fluoro
  misc_feature (20)..(21): 2'-O-methyl
  misc_feature (20)..(21): phosphorothioate linkage
uuccgcaguauggaucggcuu

SEQ ID NO: 329 - RNA, 21 nt, Artificial Sequence
  Synthetic
  misc_feature (1)..(1): inverted abasic cap
  misc_feature (1)..(1): 2'-O-methyl
  misc_feature (2)..(5): 2'-deoxy-2'-fluoro
  misc_feature (6)..(6): 2'-deoxy
  misc_feature (8)..(8): 2'-O-methyl
  misc_feature (9)..(9): 2'-deoxy-2'-fluoro
  misc_feature (10)..(10): 2'-deoxy
  misc_feature (12)..(12): 2'-deoxy
  misc_feature (13)..(13): 2'-O-methyl
  misc_feature (14)..(14): 2'-deoxy
  misc_feature (16)..(16): 2'-deoxy-2'-fluoro
  misc_feature (18)..(19): 2'-deoxy
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 330 - RNA, 21 nt, Artificial Sequence
  Synthetic
  misc_feature (1)..(3): 2'-deoxy-2'-fluoro
  misc_feature (4)..(4): 2'-O-methyl
  misc_feature (5)..(5): 2'-deoxy-2'-fluoro
  misc_feature (7)..(7): 2'-O-methyl
  misc_feature (9)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (14)..(14): 2'-deoxy-2'-fluoro
  misc_feature (16)..(16): 2'-O-methyl
  misc_feature (18)..(21): 2'-O-methyl
  misc_feature (20)..(21): phosphorothioate linkage
uuccgcaguauggaucggcuu

SEQ ID NO: 331 - RNA, 21 nt, Artificial Sequence
  Synthetic
  misc_feature (1)..(1): inverted abasic cap
  misc_feature (1)..(3): 2'-deoxy
  misc_feature (4)..(4): 2'-O-methyl
  misc_feature (5)..(5): 2'-deoxy
  misc_feature (6)..(6): 2'-deoxy-2'-fluoro
  misc_feature (7)..(7): 2'-deoxy
  misc_feature (9)..(9): 2'-deoxy-2'-fluoro
  misc_feature (10)..(10): 2'-O-methyl
  misc_feature (12)..(12): 2'-deoxy
  misc_feature (14)..(14): 2'-deoxy-2'-fluoro
  misc_feature (17)..(18): 2'-deoxy
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 332 - RNA, 21 nt, Artificial Sequence
  Synthetic
  misc_feature (1)..(1): 2'-deoxy-2'-fluoro
  misc_feature (2)..(3): 2'-O-methyl
  misc_feature (4)..(6): 2'-deoxy-2'-fluoro
  misc_feature (9)..(10): 2'-O-methyl
  misc_feature (11)..(12): 2'-deoxy-2'-fluoro
  misc_feature (14)..(14): 2'-deoxy-2'-fluoro
  misc_feature (16)..(16): 2'-O-methyl
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
auugagagaaguccaccacuu

SEQ ID NO: 333 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (6)..(7): 2'-deoxy-2'-fluoro
  misc_feature (8)..(8): 2'-O-methyl
  misc_feature (9)..(10): 2'-deoxy-2'-fluoro
  misc_feature (12)..(12): 2'-deoxy
  misc_feature (13)..(14): 2'-O-methyl
  misc_feature (16)..(17): 2'-deoxy
  misc_feature (18)..(18): 2'-deoxy-2'-fluoro
  misc_feature (19)..(21): 2'-O-methyl
  misc_feature (20)..(21): phosphorothioate linkage
  misc_feature (21)..(21): inverted abasic cap
gugguggacuucucucaauuu

SEQ ID NO: 334 - RNA, 21 nt, Artificial Sequence
  Synthetic
  misc_feature (1)..(1): 2'-deoxy-2'-fluoro
  misc_feature (2)..(3): 2'-O-methyl
  misc_feature (5)..(5): 2'-O-methyl
  misc_feature (6)..(6): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (12)..(12): 2'-O-methyl
  misc_feature (13)..(14): 2'-deoxy-2'-fluoro
  misc_feature (15)..(16): 2'-O-methyl
  misc_feature (18)..(18): 2'-O-methyl
  misc_feature (20)..(21): 2'-O-methyl
  misc_feature (20)..(21): phosphorothioate linkage
ugagagaaguccaccacgauu

SEQ ID NO: 335 - RNA, 21 nt, Artificial Sequence
  Synthetic
  misc_feature (1)..(1): inverted abasic cap
  misc_feature (1)..(1): 2'-O-methyl
  misc_feature (3)..(3): 2'-deoxy
  misc_feature (5)..(5): 2'-deoxy
  misc_feature (6)..(7): 2'-O-methyl
  misc_feature (8)..(9): 2'-deoxy-2'-fluoro
  misc_feature (10)..(10): 2'-deoxy
  misc_feature (12)..(13): 2'-deoxy-2'-fluoro
  misc_feature (14)..(15): 2'-deoxy
  misc_feature (16)..(16): 2'-O-methyl
  misc_feature (17)..(18): 2'-deoxy
  misc_feature (19)..(21): 2'-O-methyl
  misc_feature (20)..(21): phosphorothioate linkage
  misc_feature (21)..(21): inverted abasic cap
ucgugguggacuucucucauu

SEQ ID NO: 336 - RNA, 21 nt, Artificial Sequence
  Synthetic
  misc_feature (1)..(1): inverted abasic cap
  misc_feature (1)..(2): 2'-deoxy
  misc_feature (3)..(3): 2'-deoxy-2'-fluoro
  misc_feature (4)..(4): 2'-deoxy
  misc_feature (5)..(5): 2'-deoxy-2'-fluoro
  misc_feature (6)..(7): 2'-deoxy
  misc_feature (8)..(8): 2'-deoxy-2'-fluoro
  misc_feature (9)..(11): 2'-deoxy
  misc_feature (12)..(12): 2'-O-methyl
  misc_feature (14)..(14): 2'-O-methyl
  misc_feature (15)..(16): 2'-deoxy
  misc_feature (18)..(19): 2'-deoxy
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 337 - RNA, 21 nt, Artificial Sequence
  Synthetic
  misc_feature (1)..(2): 2'-O-methyl
  misc_feature (3)..(4): 2'-deoxy-2'-fluoro
  misc_feature (6)..(6): 2'-deoxy-2'-fluoro
  misc_feature (7)..(7): 2'-O-methyl
  misc_feature (8)..(8): 2'-deoxy-2'-fluoro
  misc_feature (9)..(9): 2'-O-methyl
  misc_feature (10)..(10): 2'-deoxy-2'-fluoro
  misc_feature (12)..(13): 2'-O-methyl
  misc_feature (14)..(16): 2'-deoxy-2'-fluoro
  misc_feature (17)..(17): 2'-O-methyl
  misc_feature (19)..(19): 2'-deoxy-2'-fluoro
  misc_feature (20)..(21): 2'-O-methyl
  misc_feature (20)..(21): phosphorothioate linkage
ugagagaaguccaccacgauu

SEQ ID NO: 338 - RNA, 21 nt, Artificial Sequence
  Synthetic
  misc_feature (1)..(1): inverted abasic cap
  misc_feature (1)..(1): 2'-O-methyl
  misc_feature (2)..(2): 2'-deoxy
  misc_feature (3)..(5): 2'-deoxy-2'-fluoro
  misc_feature (6)..(6): 2'-deoxy
  misc_feature (7)..(7): 2'-O-methyl
  misc_feature (8)..(8): 2'-deoxy
  misc_feature (9)..(9): 2'-O-methyl
  misc_feature (10)..(10): 2'-deoxy
  misc_feature (12)..(12): 2'-deoxy
  misc_feature (13)..(14): 2'-O-methyl
  misc_feature (17)..(17): 2'-deoxy
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 339 - RNA, 21 nt, Artificial Sequence
  Synthetic
  misc_feature (1)..(1): 2'-O-methyl
  misc_feature (2)..(2): 2'-deoxy-2'-fluoro
  misc_feature (3)..(5): 2'-O-methyl
  misc_feature (6)..(6): 2'-deoxy-2'-fluoro
  misc_feature (8)..(9): 2'-deoxy-2'-fluoro
  misc_feature (11)..(11): 2'-O-methyl
  misc_feature (14)..(14): 2'-deoxy-2'-fluoro
  misc_feature (17)..(17): 2'-O-methyl
  misc_feature (19)..(21): 2'-O-methyl
  misc_feature (20)..(21): phosphorothioate linkage
ugagagaaguccaccacgauu

SEQ ID NO: 340 - RNA, 21 nt, Artificial Sequence
  Synthetic
  misc_feature (1)..(1): inverted abasic cap
  misc_feature (1)..(2): 2'-deoxy
  misc_feature (3)..(4): 2'-O-methyl
  misc_feature (5)..(9): 2'-deoxy
  misc_feature (10)..(11): 2'-O-methyl
  misc_feature (14)..(14): 2'-deoxy
  misc_feature (15)..(15): 2'-O-methyl
  misc_feature (16)..(16): 2'-deoxy
  misc_feature (17)..(17): 2'-O-methyl
  misc_feature (18)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 341 - RNA, 21 nt, Artificial Sequence
  Synthetic
  misc_feature (1)..(1): 2'-O-methyl
  misc_feature (2)..(6): 2'-deoxy-2'-fluoro
  misc_feature (8)..(8): 2'-O-methyl
  misc_feature (10)..(11): 2'-deoxy-2'-fluoro
  misc_feature (13)..(13): 2'-O-methyl
  misc_feature (15)..(16): 2'-O-methyl
  misc_feature (17)..(18): 2'-deoxy-2'-fluoro
  misc_feature (20)..(21): 2'-O-methyl
  misc_feature (20)..(21): phosphorothioate linkage
ugagagaaguccaccacgauu

SEQ ID NO: 342 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (5)..(5): 2'-deoxy-2'-fluoro
  misc_feature (6)..(8): 2'-O-methyl
  misc_feature (9)..(9): 2'-deoxy-2'-fluoro
  misc_feature (11)..(12): 2'-O-methyl
  misc_feature (13)..(14): 2'-deoxy-2'-fluoro
  misc_feature (16)..(16): 2'-O-methyl
  misc_feature (17)..(18): 2'-deoxy-2'-fluoro
  misc_feature (20)..(21): 2'-O-methyl
  misc_feature (20)..(21): phosphorothioate linkage
guuccgcaguauggaucgguu

SEQ ID NO: 343 - RNA, 21 nt, Artificial Sequence
  Synthetic
  misc_feature (1)..(1): inverted abasic cap
  misc_feature (1)..(2): 2'-deoxy
  misc_feature (3)..(3): 2'-O-methyl
  misc_feature (4)..(4): 2'-deoxy-2'-fluoro
  misc_feature (5)..(6): 2'-deoxy
  misc_feature (7)..(7): 2'-O-methyl
  misc_feature (8)..(8): 2'-deoxy
  misc_feature (9)..(9): 2'-O-methyl
  misc_feature (10)..(10): 2'-deoxy
  misc_feature (12)..(12): 2'-deoxy
  misc_feature (14)..(15): 2'-deoxy
  misc_feature (16)..(17): 2'-deoxy-2'-fluoro
  misc_feature (18)..(18): 2'-O-methyl
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 344 - RNA, 21 nt, Artificial Sequence
  Synthetic
  misc_feature (1)..(2): 2'-deoxy-2'-fluoro
  misc_feature (3)..(4): 2'-O-methyl
  misc_feature (7)..(7): 2'-deoxy-2'-fluoro
  misc_feature (9)..(9): 2'-O-methyl
  misc_feature (10)..(10): 2'-deoxy-2'-fluoro
  misc_feature (11)..(12): 2'-O-methyl
  misc_feature (13)..(15): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
guuccgcaguauggaucgguu

SEQ ID NO: 345 - RNA, 21 nt, Artificial Sequence
  Synthetic
  misc_feature (1)..(1): inverted abasic cap
  misc_feature (2)..(2): 2'-deoxy
  misc_feature (3)..(3): 2'-deoxy-2'-fluoro
  misc_feature (4)..(4): 2'-deoxy
  misc_feature (5)..(6): 2'-O-methyl
  misc_feature (7)..(8): 2'-deoxy-2'-fluoro
  misc_feature (10)..(10): 2'-deoxy-2'-fluoro
  misc_feature (11)..(11): 2'-O-methyl
  misc_feature (12)..(13): 2'-deoxy-2'-fluoro
  misc_feature (14)..(14): 2'-O-methyl
  misc_feature (15)..(17): 2'-deoxy
  misc_feature (18)..(18): 2'-O-methyl
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 346 - RNA, 21 nt, Artificial Sequence
  Synthetic
  misc_feature (1)..(1): inverted abasic cap
  misc_feature (1)..(1): 2'-O-methyl
  misc_feature (2)..(2): 2'-deoxy-2'-fluoro
  misc_feature (4)..(4): 2'-deoxy-2'-fluoro
  misc_feature (5)..(5): 2'-deoxy
  misc_feature (6)..(7): 2'-O-methyl
  misc_feature (10)..(10): 2'-deoxy
  misc_feature (11)..(11): 2'-deoxy-2'-fluoro
  misc_feature (14)..(15): 2'-deoxy-2'-fluoro
  misc_feature (16)..(16): 2'-deoxy
  misc_feature (17)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 347 - RNA, 21 nt, Artificial Sequence
  Synthetic
  misc_feature (1)..(1): 2'-O-methyl
  misc_feature (2)..(2): 2'-deoxy-2'-fluoro
  misc_feature (3)..(3): 2'-O-methyl
  misc_feature (5)..(5): 2'-deoxy-2'-fluoro
  misc_feature (6)..(10): 2'-O-methyl
  misc_feature (11)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (19)..(21): 2'-O-methyl
  misc_feature (20)..(21): phosphorothioate linkage
uuccgcaguauggaucggcuu

SEQ ID NO: 348 - RNA, 21 nt, Artificial Sequence
  Synthetic
  misc_feature (1)..(1): inverted abasic cap
  misc_feature (1)..(1): 2'-O-methyl
  misc_feature (3)..(4): 2'-O-methyl
  misc_feature (5)..(5): 2'-deoxy-2'-fluoro
  misc_feature (6)..(6): 2'-deoxy
  misc_feature (7)..(8): 2'-O-methyl
  misc_feature (9)..(9): 2'-deoxy
  misc_feature (10)..(10): 2'-O-methyl
  misc_feature (11)..(11): 2'-deoxy
  misc_feature (13)..(13): 2'-deoxy
  misc_feature (14)..(14): 2'-O-methyl
  misc_feature (15)..(15): 2'-deoxy-2'-fluoro
  misc_feature (16)..(17): 2'-deoxy
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 349 - RNA, 21 nt, Artificial Sequence
  Synthetic
  misc_feature (1)..(1): 2'-O-methyl
  misc_feature (2)..(3): 2'-deoxy-2'-fluoro
  misc_feature (4)..(4): 2'-O-methyl
  misc_feature (5)..(5): 2'-deoxy-2'-fluoro
  misc_feature (6)..(6): 2'-O-methyl
  misc_feature (8)..(8): 2'-O-methyl
  misc_feature (10)..(10): 2'-O-methyl
  misc_feature (11)..(11): 2'-deoxy-2'-fluoro
  misc_feature (13)..(14): 2'-deoxy-2'-fluoro
  misc_feature (16)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
uuccgcaguauggaucggcuu

SEQ ID NO: 350 - RNA, 21 nt, Artificial Sequence
  Synthetic
  misc_feature (1)..(3): 2'-deoxy-2'-fluoro
  misc_feature (6)..(6): 2'-O-methyl
  misc_feature (7)..(7): 2'-deoxy-2'-fluoro
  misc_feature (8)..(9): 2'-O-methyl
  misc_feature (10)..(11): 2'-deoxy-2'-fluoro
  misc_feature (12)..(13): 2'-O-methyl
  misc_feature (16)..(16): 2'-deoxy-2'-fluoro
  misc_feature (17)..(18): 2'-O-methyl
  misc_feature (20)..(21): 2'-O-methyl
  misc_feature (20)..(21): phosphorothioate linkage
auugagagaaguccaccacuu

SEQ ID NO: 351 - RNA, 21 nt, Artificial Sequence
  Synthetic
  misc_feature (1)..(1): inverted abasic cap
  misc_feature (1)..(1): 2'-deoxy
  misc_feature (2)..(2): 2'-O-methyl
  misc_feature (3)..(3): 2'-deoxy-2'-fluoro
  misc_feature (5)..(5): 2'-deoxy
  misc_feature (6)..(6): 2'-O-methyl
  misc_feature (7)..(7): 2'-deoxy
  misc_feature (9)..(9): 2'-deoxy-2'-fluoro
  misc_feature (12)..(12): 2'-O-methyl
  misc_feature (13)..(13): 2'-deoxy
  misc_feature (14)..(14): 2'-O-methyl
  misc_feature (15)..(15): 2'-deoxy-2'-fluoro
  misc_feature (16)..(16): 2'-deoxy
  misc_feature (17)..(17): 2'-O-methyl
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 352 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(3): 2'-deoxy
  misc_feature (4)..(4): 2'-deoxy-2'-fluoro
  misc_feature (6)..(6): 2'-O-methyl
  misc_feature (7)..(8): 2'-deoxy
  misc_feature (10)..(11): 2'-deoxy
  misc_feature (12)..(12): 2'-O-methyl
  misc_feature (13)..(14): 2'-deoxy
  misc_feature (15)..(17): 2'-O-methyl
  misc_feature (18)..(18): 2'-deoxy
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 353 - RNA, 21 nt, Artificial Sequence
  Synthetic
  misc_feature (1)..(2): 2'-O-methyl
  misc_feature (3)..(3): 2'-deoxy-2'-fluoro
  misc_feature (5)..(5): 2'-deoxy-2'-fluoro
  misc_feature (6)..(8): 2'-O-methyl
  misc_feature (10)..(10): 2'-deoxy-2'-fluoro
  misc_feature (13)..(13): 2'-O-methyl
  misc_feature (14)..(16): 2'-deoxy-2'-fluoro
  misc_feature (17)..(18): 2'-O-methyl
  misc_feature (20)..(21): 2'-O-methyl
  misc_feature (20)..(21): phosphorothioate linkage
auugagagaaguccaccacuu

SEQ ID NO: 354 - RNA, 21 nt, Artificial Sequence
  Synthetic
  misc_feature (1)..(5): 2'-deoxy-2'-fluoro
  misc_feature (6)..(7): 2'-O-methyl
  misc_feature (9)..(9): 2'-O-methyl
  misc_feature (11)..(11): 2'-O-methyl
  misc_feature (12)..(12): 2'-deoxy-2'-fluoro
  misc_feature (15)..(15): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
  misc_feature (20)..(21): phosphorothioate linkage
ugagagaaguccaccacgauu

SEQ ID NO: 355 - RNA, 21 nt, Artificial Sequence
  Synthetic
  misc_feature (1)..(1): inverted abasic cap
  misc_feature (2)..(2): 2'-O-methyl
  misc_feature (3)..(3): 2'-deoxy
  misc_feature (5)..(5): 2'-O-methyl
  misc_feature (6)..(8): 2'-deoxy
  misc_feature (9)..(10): 2'-deoxy-2'-fluoro
  misc_feature (11)..(11): 2'-O-methyl
  misc_feature (13)..(13): 2'-O-methyl
  misc_feature (14)..(17): 2'-deoxy
  misc_feature (18)..(18): 2'-O-methyl
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 356 - RNA, 21 nt, Artificial Sequence
  Synthetic
  misc_feature (1)..(1): inverted abasic cap
  misc_feature (1)..(1): 2'-deoxy
  misc_feature (3)..(5): 2'-deoxy-2'-fluoro
  misc_feature (8)..(8): 2'-deoxy
  misc_feature (9)..(9): 2'-O-methyl
  misc_feature (10)..(10): 2'-deoxy
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(17): 2'-deoxy
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 357 - RNA, 21 nt, Artificial Sequence
  Synthetic
  misc_feature (1)..(1): 2'-O-methyl
  misc_feature (2)..(3): 2'-deoxy-2'-fluoro
  misc_feature (4)..(5): 2'-O-methyl
  misc_feature (7)..(7): 2'-deoxy-2'-fluoro
  misc_feature (9)..(9): 2'-O-methyl
  misc_feature (10)..(10): 2'-deoxy-2'-fluoro
  misc_feature (12)..(13): 2'-O-methyl
  misc_feature (14)..(15): 2'-deoxy-2'-fluoro
  misc_feature (16)..(16): 2'-O-methyl
  misc_feature (18)..(18): 2'-O-methyl
  misc_feature (20)..(21): 2'-O-methyl
  misc_feature (20)..(21): phosphorothioate linkage
uuccgcaguauggaucggcuu

SEQ ID NO: 358 - RNA, 21 nt, Artificial Sequence
  Synthetic
  misc_feature (1)..(1): inverted abasic cap
  misc_feature (1)..(1): 2'-deoxy
  misc_feature (2)..(2): 2'-deoxy-2'-fluoro
  misc_feature (3)..(3): 2'-O-methyl
  misc_feature (4)..(4): 2'-deoxy-2'-fluoro
  misc_feature (6)..(6): 2'-deoxy-2'-fluoro
  misc_feature (7)..(7): 2'-O-methyl
  misc_feature (9)..(11): 2'-O-methyl
  misc_feature (12)..(12): 2'-deoxy-2'-fluoro
  misc_feature (15)..(15): 2'-deoxy
  misc_feature (16)..(17): 2'-deoxy-2'-fluoro
  misc_feature (18)..(18): 2'-deoxy
  misc_feature (19)..(21): 2'-O-methyl
  misc_feature (20)..(21): phosphorothioate linkage
  misc_feature (21)..(21): inverted abasic cap
gugguggacuucucucaauuu

SEQ ID NO: 359 - RNA, 21 nt, Artificial Sequence
  Synthetic
  misc_feature (1)..(3): 2'-O-methyl
  misc_feature (4)..(6): 2'-deoxy-2'-fluoro
  misc_feature (8)..(8): 2'-deoxy-2'-fluoro
  misc_feature (9)..(10): 2'-O-methyl
  misc_feature (13)..(13): 2'-deoxy-2'-fluoro
  misc_feature (16)..(16): 2'-deoxy-2'-fluoro
  misc_feature (19)..(19): 2'-deoxy-2'-fluoro
  misc_feature (20)..(21): 2'-O-methyl
  misc_feature (20)..(21): phosphorothioate linkage
auugagagaaguccaccacuu

SEQ ID NO: 360 - RNA, 21 nt, Artificial Sequence
  Synthetic
  misc_feature (1)..(1): 2'-deoxy-2'-fluoro
  misc_feature (2)..(3): 2'-O-methyl
  misc_feature (6)..(6): 2'-deoxy-2'-fluoro
  misc_feature (7)..(7): 2'-O-methyl
  misc_feature (8)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (15)..(15): 2'-deoxy-2'-fluoro
  misc_feature (17)..(17): 2'-deoxy-2'-fluoro
  misc_feature (19)..(19): 2'-deoxy-2'-fluoro
  misc_feature (20)..(21): 2'-O-methyl
  misc_feature (20)..(21): phosphorothioate linkage
auugagagaaguccaccacuu

SEQ ID NO: 361 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-O-methyl
  misc_feature (3)..(3): 2'-deoxy
  misc_feature (4)..(5): 2'-deoxy-2'-fluoro
  misc_feature (6)..(6): 2'-O-methyl
  misc_feature (7)..(8): 2'-deoxy-2'-fluoro
  misc_feature (9)..(10): 2'-O-methyl
  misc_feature (11)..(11): 2'-deoxy-2'-fluoro
  misc_feature (15)..(15): 2'-deoxy
  misc_feature (16)..(16): 2'-O-methyl
  misc_feature (17)..(17): 2'-deoxy
  misc_feature (18)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 362 - RNA, 21 nt, Artificial Sequence
  Synthetic
  misc_feature (1)..(2): 2'-deoxy-2'-fluoro
  misc_feature (3)..(3): 2'-O-methyl
  misc_feature (5)..(7): 2'-deoxy-2'-fluoro
  misc_feature (8)..(8): 2'-O-methyl
  misc_feature (9)..(9): 2'-deoxy-2'-fluoro
  misc_feature (11)..(12): 2'-O-methyl
  misc_feature (14)..(15): 2'-deoxy-2'-fluoro
  misc_feature (16)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
auugagagaaguccaccacuu

SEQ ID NO: 363 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (4)..(4): 2'-deoxy
  misc_feature (5)..(7): 2'-deoxy-2'-fluoro
  misc_feature (8)..(8): 2'-deoxy
  misc_feature (10)..(10): 2'-O-methyl
  misc_feature (11)..(15): 2'-deoxy
  misc_feature (17)..(17): 2'-deoxy-2'-fluoro
  misc_feature (18)..(19): 2'-deoxy
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 364 - RNA, 21 nt, Artificial Sequence
  Synthetic
  misc_feature (1)..(1): inverted abasic cap
  misc_feature (1)..(5): 2'-deoxy
  misc_feature (6)..(6): 2'-deoxy-2'-fluoro
  misc_feature (7)..(7): 2'-O-methyl
  misc_feature (8)..(9): 2'-deoxy-2'-fluoro
  misc_feature (10)..(10): 2'-O-methyl
  misc_feature (11)..(12): 2'-deoxy
  misc_feature (13)..(13): 2'-O-methyl
  misc_feature (15)..(15): 2'-O-methyl
  misc_feature (16)..(19): 2'-deoxy
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 365 - RNA, 21 nt, Artificial Sequence
  Synthetic
  misc_feature (1)..(3): 2'-O-methyl
  misc_feature (4)..(4): 2'-deoxy-2'-fluoro
  misc_feature (5)..(5): 2'-O-methyl
  misc_feature (7)..(7): 2'-deoxy-2'-fluoro
  misc_feature (9)..(10): 2'-deoxy-2'-fluoro
  misc_feature (11)..(11): 2'-O-methyl
  misc_feature (13)..(13): 2'-O-methyl
  misc_feature (14)..(14): 2'-deoxy-2'-fluoro
  misc_feature (16)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
ugagagaaguccaccacgauu

SEQ ID NO: 366 - RNA, 21 nt, Artificial Sequence
  Synthetic
  misc_feature (1)..(1): inverted abasic cap
  misc_feature (1)..(1): 2'-deoxy
  misc_feature (3)..(3): 2'-deoxy-2'-fluoro
  misc_feature (4)..(4): 2'-deoxy
  misc_feature (5)..(6): 2'-deoxy-2'-fluoro
  misc_feature (8)..(8): 2'-deoxy
  misc_feature (9)..(9): 2'-deoxy-2'-fluoro
  misc_feature (10)..(10): 2'-deoxy
  misc_feature (11)..(11): 2'-O-methyl
  misc_feature (12)..(15): 2'-deoxy
  misc_feature (16)..(16): 2'-O-methyl
  misc_feature (17)..(17): 2'-deoxy
  misc_feature (18)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 367 - RNA, 21 nt, Artificial Sequence
  Synthetic
  misc_feature (1)..(3): 2'-O-methyl
  misc_feature (4)..(7): 2'-deoxy-2'-fluoro
  misc_feature (8)..(9): 2'-O-methyl
  misc_feature (11)..(11): 2'-deoxy-2'-fluoro
  misc_feature (12)..(12): 2'-O-methyl
  misc_feature (14)..(14): 2'-deoxy-2'-fluoro
  misc_feature (15)..(15): 2'-O-methyl
  misc_feature (17)..(17): 2'-deoxy-2'-fluoro
  misc_feature (18)..(21): 2'-O-methyl
  misc_feature (20)..(21): phosphorothioate linkage
ugagagaaguccaccacgauu

SEQ ID NO: 368 - RNA, 21 nt, Artificial Sequence
  Synthetic
  misc_feature (1)..(1): inverted abasic cap
  misc_feature (1)..(1): 2'-deoxy
  misc_feature (2)..(2): 2'-O-methyl
  misc_feature (3)..(4): 2'-deoxy
  misc_feature (6)..(6): 2'-deoxy
  misc_feature (7)..(7): 2'-O-methyl
  misc_feature (8)..(8): 2'-deoxy-2'-fluoro
  misc_feature (9)..(9): 2'-deoxy
  misc_feature (10)..(10): 2'-deoxy-2'-fluoro
  misc_feature (11)..(11): 2'-deoxy
  misc_feature (13)..(13): 2'-deoxy-2'-fluoro
  misc_feature (15)..(15): 2'-deoxy-2'-fluoro
  misc_feature (16)..(17): 2'-deoxy
  misc_feature (18)..(18): 2'-deoxy-2'-fluoro
  misc_feature (19)..(21): 2'-O-methyl
  misc_feature (20)..(21): phosphorothioate linkage
  misc_feature (21)..(21): inverted abasic cap
ccgauccauacugcggaacuu

SEQ ID NO: 369 - RNA, 21 nt, Artificial Sequence
  Synthetic
  misc_feature (1)..(1): 2'-O-methyl
  misc_feature (2)..(3): 2'-deoxy-2'-fluoro
  misc_feature (4)..(5): 2'-O-methyl
  misc_feature (6)..(6): 2'-deoxy-2'-fluoro
  misc_feature (8)..(10): 2'-O-methyl
  misc_feature (12)..(14): 2'-deoxy-2'-fluoro
  misc_feature (15)..(16): 2'-O-methyl
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
guuccgcaguauggaucgguu

SEQ ID NO: 370 - RNA, 21 nt, Artificial Sequence
  Synthetic
  misc_feature (1)..(2): 2'-deoxy-2'-fluoro
  misc_feature (3)..(3): 2'-O-methyl
  misc_feature (4)..(4): 2'-deoxy-2'-fluoro
  misc_feature (5)..(8): 2'-O-methyl
  misc_feature (9)..(10): 2'-deoxy-2'-fluoro
  misc_feature (12)..(12): 2'-deoxy-2'-fluoro
  misc_feature (14)..(15): 2'-deoxy-2'-fluoro
  misc_feature (16)..(16): 2'-O-methyl
  misc_feature (18)..(21): 2'-O-methyl
  misc_feature (20)..(21): phosphorothioate linkage
guuccgcaguauggaucgguu

SEQ ID NO: 371 - RNA, 21 nt, Artificial Sequence
  Synthetic
  misc_feature (1)..(1): inverted abasic cap
  misc_feature (1)..(1): 2'-deoxy
  misc_feature (2)..(2): 2'-O-methyl
  misc_feature (3)..(3): 2'-deoxy-2'-fluoro
  misc_feature (4)..(4): 2'-O-methyl
  misc_feature (5)..(5): 2'-deoxy
  misc_feature (6)..(6): 2'-deoxy-2'-fluoro
  misc_feature (9)..(9): 2'-deoxy-2'-fluoro
  misc_feature (10)..(10): 2'-deoxy
  misc_feature (11)..(11): 2'-O-methyl
  misc_feature (13)..(13): 2'-deoxy
  misc_feature (15)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 372 - RNA, 21 nt, Artificial Sequence
  Synthetic
  misc_feature (1)..(1): 2'-deoxy-2'-fluoro
  misc_feature (2)..(4): 2'-O-methyl
  misc_feature (5)..(6): 2'-deoxy-2'-fluoro
  misc_feature (9)..(9): 2'-O-methyl
  misc_feature (12)..(15): 2'-deoxy-2'-fluoro
  misc_feature (17)..(17): 2'-O-methyl
  misc_feature (18)..(18): 2'-deoxy-2'-fluoro
  misc_feature (19)..(21): 2'-O-methyl
  misc_feature (20)..(21): phosphorothioate linkage
guuccgcaguauggaucgguu

SEQ ID NO: 373 - RNA, 21 nt, Artificial Sequence
  Synthetic
  misc_feature (1)..(1): inverted abasic cap
  misc_feature (2)..(2): 2'-deoxy-2'-fluoro
  misc_feature (3)..(3): 2'-deoxy
  misc_feature (4)..(4): 2'-deoxy-2'-fluoro
  misc_feature (5)..(6): 2'-deoxy
  misc_feature (7)..(8): 2'-O-methyl
  misc_feature (9)..(9): 2'-deoxy
  misc_feature (10)..(10): 2'-deoxy-2'-fluoro
  misc_feature (12)..(12): 2'-O-methyl
  misc_feature (13)..(14): 2'-deoxy
  misc_feature (16)..(16): 2'-deoxy
  misc_feature (17)..(17): 2'-O-methyl
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 374 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-O-methyl
  misc_feature (3)..(3): 2'-deoxy
  misc_feature (4)..(4): 2'-deoxy-2'-fluoro
  misc_feature (5)..(5): 2'-deoxy
  misc_feature (7)..(8): 2'-O-methyl
  misc_feature (9)..(9): 2'-deoxy
  misc_feature (10)..(10): 2'-O-methyl
  misc_feature (11)..(11): 2'-deoxy-2'-fluoro
  misc_feature (12)..(13): 2'-deoxy
  misc_feature (14)..(14): 2'-deoxy-2'-fluoro
  misc_feature (16)..(16): 2'-deoxy-2'-fluoro
  misc_feature (17)..(18): 2'-deoxy
  misc_feature (19)..(21): 2'-O-methyl
  misc_feature (20)..(21): phosphorothioate linkage
  misc_feature (21)..(21): inverted abasic cap
gccgauccauacugcggaauu

SEQ ID NO: 375 - RNA, 21 nt, Artificial Sequence
  Synthetic
  misc_feature (1)..(1): 2'-O-methyl
  misc_feature (2)..(2): 2'-deoxy-2'-fluoro
  misc_feature (3)..(3): 2'-O-methyl
  misc_feature (5)..(7): 2'-O-methyl
  misc_feature (8)..(8): 2'-deoxy-2'-fluoro
  misc_feature (9)..(9): 2'-O-methyl
  misc_feature (11)..(12): 2'-O-methyl
  misc_feature (14)..(14): 2'-deoxy-2'-fluoro
  misc_feature (15)..(15): 2'-O-methyl
  misc_feature (17)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
uuccgcaguauggaucggcuu

SEQ ID NO: 376 - RNA, 21 nt, Artificial Sequence
  Synthetic
  misc_feature (1)..(2): 2'-deoxy-2'-fluoro
  misc_feature (3)..(4): 2'-O-methyl
  misc_feature (5)..(8): 2'-deoxy-2'-fluoro
  misc_feature (9)..(9): 2'-O-methyl
  misc_feature (10)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (17)..(18): 2'-O-methyl
  misc_feature (20)..(21): 2'-O-methyl
  misc_feature (20)..(21): phosphorothioate linkage
uuccgcaguauggaucggcuu

SEQ ID NO: 377 - RNA, 21 nt, Artificial Sequence
  Synthetic
  misc_feature (1)..(1): inverted abasic cap
  misc_feature (1)..(1): 2'-O-methyl
  misc_feature (3)..(3): 2'-O-methyl
  misc_feature (4)..(7): 2'-deoxy
  misc_feature (8)..(8): 2'-O-methyl
  misc_feature (9)..(10): 2'-deoxy
  misc_feature (11)..(11): 2'-O-methyl
  misc_feature (12)..(12): 2'-deoxy
  misc_feature (13)..(13): 2'-O-methyl
  misc_feature (14)..(14): 2'-deoxy-2'-fluoro
  misc_feature (15)..(16): 2'-deoxy
  misc_feature (17)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 378 - RNA, 21 nt, Artificial Sequence
  Synthetic
  misc_feature (1)..(1): inverted abasic cap
  misc_feature (2)..(4): 2'-O-methyl
  misc_feature (5)..(5): 2'-deoxy
  misc_feature (6)..(6): 2'-O-methyl
  misc_feature (8)..(10): 2'-deoxy-2'-fluoro
  misc_feature (11)..(11): 2'-deoxy
  misc_feature (12)..(12): 2'-O-methyl
  misc_feature (13)..(13): 2'-deoxy
  misc_feature (14)..(14): 2'-deoxy-2'-fluoro
  misc_feature (16)..(16): 2'-O-methyl
  misc_feature (17)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 379 - RNA, 21 nt, Artificial Sequence
  Synthetic
  misc_feature (1)..(3): 2'-O-methyl
  misc_feature (5)..(5): 2'-O-methyl
  misc_feature (6)..(6): 2'-deoxy-2'-fluoro
  misc_feature (8)..(9): 2'-O-methyl
  misc_feature (10)..(10): 2'-deoxy-2'-fluoro
  misc_feature (13)..(16): 2'-deoxy-2'-fluoro
  misc_feature (18)..(18): 2'-deoxy-2'-fluoro
  misc_feature (19)..(21): 2'-O-methyl
  misc_feature (20)..(21): phosphorothioate linkage
uuccgcaguauggaucggcuu

SEQ ID NO: 380 - RNA, 21 nt, Artificial Sequence
  Synthetic
  misc_feature (1)..(1): inverted abasic cap
  misc_feature (1)..(2): 2'-deoxy
  misc_feature (3)..(3): 2'-deoxy-2'-fluoro
  misc_feature (4)..(4): 2'-deoxy
  misc_feature (5)..(6): 2'-deoxy-2'-fluoro
  misc_feature (7)..(7): 2'-deoxy
  misc_feature (8)..(10): 2'-deoxy-2'-fluoro
  misc_feature (11)..(18): 2'-deoxy
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 381 - RNA, 21 nt, Artificial Sequence
  Synthetic
  misc_feature (1)..(1): 2'-O-methyl
  misc_feature (2)..(3): 2'-deoxy-2'-fluoro
  misc_feature (4)..(4): 2'-O-methyl
  misc_feature (6)..(7): 2'-O-methyl
  misc_feature (8)..(9): 2'-deoxy-2'-fluoro
  misc_feature (10)..(11): 2'-O-methyl
  misc_feature (12)..(14): 2'-deoxy-2'-fluoro
  misc_feature (15)..(16): 2'-O-methyl
  misc_feature (18)..(18): 2'-deoxy-2'-fluoro
  misc_feature (20)..(21): 2'-O-methyl
  misc_feature (20)..(21): phosphorothioate linkage
ugagagaaguccaccacgauu

SEQ ID NO: 382 - RNA, 21 nt, Artificial Sequence
  Synthetic
  misc_feature (1)..(1): 2'-deoxy-2'-fluoro
  misc_feature (2)..(3): 2'-O-methyl
  misc_feature (4)..(4): 2'-deoxy-2'-fluoro
  misc_feature (6)..(6): 2'-deoxy-2'-fluoro
  misc_feature (7)..(7): 2'-O-methyl
  misc_feature (9)..(10): 2'-deoxy-2'-fluoro
  misc_feature (11)..(11): 2'-O-methyl
  misc_feature (13)..(13): 2'-O-methyl
  misc_feature (16)..(17): 2'-deoxy-2'-fluoro
  misc_feature (18)..(21): 2'-O-methyl
  misc_feature (20)..(21): phosphorothioate linkage
ugagagaaguccaccacgauu

SEQ ID NO: 383 - RNA, 21 nt, Artificial Sequence
  Synthetic
  misc_feature (1)..(1): inverted abasic cap
  misc_feature (1)..(3): 2'-deoxy-2'-fluoro
  misc_feature (5)..(5): 2'-deoxy-2'-fluoro
  misc_feature (6)..(7): 2'-O-methyl
  misc_feature (8)..(8): 2'-deoxy-2'-fluoro
  misc_feature (9)..(9): 2'-deoxy
  misc_feature (10)..(10): 2'-deoxy-2'-fluoro
  misc_feature (11)..(12): 2'-O-methyl
  misc_feature (13)..(13): 2'-deoxy-2'-fluoro
  misc_feature (15)..(15): 2'-O-methyl
  misc_feature (17)..(17): 2'-deoxy
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 384 - RNA, 21 nt, Artificial Sequence
  Synthetic
  misc_feature (1)..(2): 2'-deoxy-2'-fluoro
  misc_feature (3)..(3): 2'-O-methyl
  misc_feature (4)..(5): 2'-deoxy-2'-fluoro
  misc_feature (6)..(6): 2'-O-methyl
  misc_feature (8)..(8): 2'-deoxy-2'-fluoro
  misc_feature (9)..(11): 2'-O-methyl
  misc_feature (13)..(14): 2'-deoxy-2'-fluoro
  misc_feature (16)..(17): 2'-O-methyl
  misc_feature (19)..(19): 2'-deoxy-2'-fluoro
  misc_feature (20)..(21): 2'-O-methyl
  misc_feature (20)..(21): phosphorothioate linkage
guuccgcaguauggaucgguu

SEQ ID NO: 385 - RNA, 21 nt, Artificial Sequence
  Synthetic
  misc_feature (1)..(1): inverted abasic cap
  misc_feature (1)..(1): 2'-O-methyl
  misc_feature (2)..(2): 2'-deoxy
  misc_feature (3)..(3): 2'-deoxy-2'-fluoro
  misc_feature (4)..(5): 2'-deoxy
  misc_feature (6)..(6): 2'-deoxy-2'-fluoro
  misc_feature (8)..(8): 2'-deoxy-2'-fluoro
  misc_feature (9)..(10): 2'-O-methyl
  misc_feature (12)..(12): 2'-deoxy
  misc_feature (13)..(13): 2'-deoxy-2'-fluoro
  misc_feature (16)..(16): 2'-deoxy-2'-fluoro
  misc_feature (17)..(19): 2'-deoxy
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 386 - RNA, 21 nt, Artificial Sequence
  Synthetic
  misc_feature (1)..(1): 2'-deoxy-2'-fluoro
  misc_feature (2)..(4): 2'-O-methyl
  misc_feature (7)..(7): 2'-O-methyl
  misc_feature (8)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (14)..(17): 2'-deoxy-2'-fluoro
  misc_feature (19)..(21): 2'-O-methyl
  misc_feature (20)..(21): phosphorothioate linkage
guuccgcaguauggaucgguu

SEQ ID NO: 387 - RNA, 21 nt, Artificial Sequence
  Synthetic
  misc_feature (1)..(1): inverted abasic cap
  misc_feature (1)..(2): 2'-deoxy
  misc_feature (3)..(3): 2'-deoxy-2'-fluoro
  misc_feature (4)..(5): 2'-deoxy
  misc_feature (7)..(13): 2'-deoxy
  misc_feature (14)..(14): 2'-O-methyl
  misc_feature (15)..(15): 2'-deoxy
  misc_feature (16)..(18): 2'-deoxy-2'-fluoro
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 388 - RNA, 21 nt, Artificial Sequence
  Synthetic
  misc_feature (1)..(1): 2'-deoxy-2'-fluoro
  misc_feature (2)..(3): 2'-O-methyl
  misc_feature (4)..(5): 2'-deoxy-2'-fluoro
  misc_feature (6)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (16)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
guuccgcaguauggaucgguu

SEQ ID NO: 389 - RNA, 21 nt, Artificial Sequence
  Synthetic
  misc_feature (1)..(1): inverted abasic cap
  misc_feature (1)..(2): 2'-deoxy
  misc_feature (3)..(4): 2'-deoxy-2'-fluoro
  misc_feature (5)..(7): 2'-deoxy
  misc_feature (8)..(8): 2'-deoxy-2'-fluoro
  misc_feature (9)..(9): 2'-deoxy
  misc_feature (10)..(10): 2'-deoxy-2'-fluoro
  misc_feature (11)..(12): 2'-deoxy
  misc_feature (13)..(13): 2'-deoxy-2'-fluoro
  misc_feature (14)..(14): 2'-deoxy
  misc_feature (15)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 390 - RNA, 21 nt, Artificial Sequence
  Synthetic
  misc_feature (1)..(1): inverted abasic cap
  misc_feature (1)..(1): 2'-deoxy-2'-fluoro
  misc_feature (4)..(4): 2'-deoxy-2'-fluoro
  misc_feature (5)..(5): 2'-O-methyl
  misc_feature (7)..(7): 2'-deoxy
  misc_feature (8)..(8): 2'-deoxy-2'-fluoro
  misc_feature (9)..(10): 2'-deoxy
  misc_feature (11)..(12): 2'-O-methyl
  misc_feature (13)..(14): 2'-deoxy
  misc_feature (15)..(16): 2'-deoxy-2'-fluoro
  misc_feature (17)..(17): 2'-O-methyl
  misc_feature (18)..(18): 2'-deoxy
  misc_feature (20)..(21): 2'-O-methyl
  misc_feature (20)..(21): phosphorothioate linkage
  misc_feature (21)..(21): inverted abasic cap
ccgauccauacugcggaacuu

SEQ ID NO: 391 - RNA, 21 nt, Artificial Sequence
  Synthetic
  misc_feature (1)..(1): 2'-O-methyl
  misc_feature (2)..(2): 2'-deoxy-2'-fluoro
  misc_feature (3)..(3): 2'-O-methyl
  misc_feature (5)..(6): 2'-deoxy-2'-fluoro
  misc_feature (7)..(8): 2'-O-methyl
  misc_feature (10)..(13): 2'-deoxy-2'-fluoro
  misc_feature (15)..(15): 2'-deoxy-2'-fluoro
  misc_feature (17)..(17): 2'-O-methyl
  misc_feature (18)..(18): 2'-deoxy-2'-fluoro
  misc_feature (20)..(21): 2'-O-methyl
  misc_feature (20)..(21): phosphorothioate linkage
guuccgcaguauggaucgguu

SEQ ID NO: 392 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(4): 2'-deoxy
  misc_feature (5)..(5): 2'-deoxy-2'-fluoro
  misc_feature (6)..(7): 2'-O-methyl
  misc_feature (9)..(9): 2'-deoxy-2'-fluoro
  misc_feature (11)..(14): 2'-deoxy
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 393 - RNA, 21 nt, Artificial Sequence
  Synthetic
  misc_feature (1)..(2): 2'-O-methyl
  misc_feature (3)..(3): 2'-deoxy-2'-fluoro
  misc_feature (4)..(4): 2'-O-methyl
  misc_feature (5)..(5): 2'-deoxy-2'-fluoro
  misc_feature (8)..(8): 2'-O-methyl
  misc_feature (10)..(11): 2'-deoxy-2'-fluoro
  misc_feature (12)..(12): 2'-O-methyl
  misc_feature (16)..(18): 2'-deoxy-2'-fluoro
  misc_feature (19)..(21): 2'-O-methyl
  misc_feature (20)..(21): phosphorothioate linkage
uuccgcaguauggaucggcuu

SEQ ID NO: 394 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-O-methyl
  misc_feature (4)..(4): 2'-deoxy
  misc_feature (5)..(5): 2'-deoxy-2'-fluoro
  misc_feature (6)..(8): 2'-deoxy
  misc_feature (9)..(9): 2'-deoxy-2'-fluoro
  misc_feature (10)..(10): 2'-deoxy
  misc_feature (11)..(11): 2'-deoxy-2'-fluoro
  misc_feature (12)..(12): 2'-O-methyl
  misc_feature (13)..(13): 2'-deoxy
  misc_feature (14)..(14): 2'-deoxy-2'-fluoro
  misc_feature (15)..(16): 2'-deoxy
  misc_feature (17)..(17): 2'-deoxy-2'-fluoro
  misc_feature (18)..(19): 2'-deoxy
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 395 - RNA, 21 nt, Artificial Sequence
  Synthetic
  misc_feature (1)..(6): 2'-O-methyl
  misc_feature (7)..(7): 2'-deoxy-2'-fluoro
  misc_feature (9)..(9): 2'-deoxy-2'-fluoro
  misc_feature (10)..(12): 2'-O-methyl
  misc_feature (13)..(17): 2'-deoxy-2'-fluoro
  misc_feature (20)..(21): 2'-O-methyl
  misc_feature (20)..(21): phosphorothioate linkage
uuccgcaguauggaucggcuu

SEQ ID NO: 396 - RNA, 21 nt, Artificial Sequence
  Synthetic
  misc_feature (1)..(1): 2'-deoxy-2'-fluoro
  misc_feature (2)..(4): 2'-O-methyl
  misc_feature (6)..(6): 2'-O-methyl
  misc_feature (8)..(10): 2'-O-methyl
  misc_feature (12)..(13): 2'-O-methyl
  misc_feature (14)..(14): 2'-deoxy-2'-fluoro
  misc_feature (16)..(19): 2'-deoxy-2'-fluoro
  misc_feature (20)..(21): 2'-O-methyl
  misc_feature (20)..(21): phosphorothioate linkage
uuccgcaguauggaucggcuu

SEQ ID NO: 397 - RNA, 21 nt, Artificial Sequence
  Synthetic
  misc_feature (1)..(1): inverted abasic cap
  misc_feature (1)..(1): 2'-O-methyl
  misc_feature (2)..(2): 2'-deoxy
  misc_feature (3)..(3): 2'-O-methyl
  misc_feature (4)..(6): 2'-deoxy
  misc_feature (7)..(7): 2'-O-methyl
  misc_feature (8)..(8): 2'-deoxy
  misc_feature (9)..(9): 2'-O-methyl
  misc_feature (12)..(12): 2'-O-methyl
  misc_feature (14)..(15): 2'-deoxy
  misc_feature (16)..(16): 2'-deoxy-2'-fluoro
  misc_feature (17)..(19): 2'-deoxy
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 398 - RNA, 21 nt, Artificial Sequence
  Synthetic
  misc_feature (1)..(1): inverted abasic cap
  misc_feature (2)..(3): 2'-deoxy
  misc_feature (4)..(4): 2'-deoxy-2'-fluoro
  misc_feature (5)..(5): 2'-O-methyl
  misc_feature (7)..(7): 2'-deoxy
  misc_feature (8)..(10): 2'-O-methyl
  misc_feature (11)..(16): 2'-deoxy
  misc_feature (17)..(17): 2'-O-methyl
  misc_feature (18)..(19): 2'-deoxy
  misc_feature (20)..(21): 2'-O-methyl
  misc_feature (20)..(21): phosphorothioate linkage
  misc_feature (21)..(21): inverted abasic cap
gccgauccauacugcggaauu

SEQ ID NO: 399 - RNA, 21 nt, Artificial Sequence
  Synthetic
  misc_feature (1)..(2): 2'-O-methyl
  misc_feature (3)..(3): 2'-deoxy-2'-fluoro
  misc_feature (5)..(5): 2'-deoxy-2'-fluoro
  misc_feature (7)..(8): 2'-O-methyl
  misc_feature (9)..(9): 2'-deoxy-2'-fluoro
  misc_feature (11)..(15): 2'-deoxy-2'-fluoro
  misc_feature (16)..(17): 2'-O-methyl
  misc_feature (19)..(21): 2'-O-methyl
  misc_feature (20)..(21): phosphorothioate linkage
uuccgcaguauggaucggcuu

SEQ ID NO: 400 - RNA, 21 nt, Artificial Sequence
  Synthetic
  misc_feature (1)..(1): inverted abasic cap
  misc_feature (2)..(3): 2'-deoxy-2'-fluoro
  misc_feature (4)..(4): 2'-deoxy
  misc_feature (6)..(6): 2'-deoxy
  misc_feature (7)..(8): 2'-deoxy-2'-fluoro
  misc_feature (9)..(9): 2'-deoxy
  misc_feature (10)..(11): 2'-O-methyl
  misc_feature (12)..(13): 2'-deoxy
  misc_feature (14)..(14): 2'-O-methyl
  misc_feature (15)..(15): 2'-deoxy
  misc_feature (16)..(16): 2'-deoxy-2'-fluoro
  misc_feature (17)..(18): 2'-O-methyl
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 401 - RNA, 21 nt, Artificial Sequence
  Synthetic
  misc_feature (1)..(1): 2'-O-methyl
  misc_feature (2)..(2): 2'-deoxy-2'-fluoro
  misc_feature (3)..(4): 2'-O-methyl
  misc_feature (6)..(6): 2'-O-methyl
  misc_feature (7)..(7): 2'-deoxy-2'-fluoro
  misc_feature (8)..(8): 2'-O-methyl
  misc_feature (9)..(10): 2'-deoxy-2'-fluoro
  misc_feature (16)..(18): 2'-deoxy-2'-fluoro
  misc_feature (19)..(21): 2'-O-methyl
  misc_feature (20)..(21): phosphorothioate linkage
auugagagaaguccaccacuu

SEQ ID NO: 402 - RNA, 21 nt, Artificial Sequence
  Synthetic
  misc_feature (1)..(1): inverted abasic cap
  misc_feature (1)..(1): 2'-O-methyl
  misc_feature (2)..(7): 2'-deoxy
  misc_feature (8)..(8): 2'-O-methyl
  misc_feature (10)..(10): 2'-deoxy
  misc_feature (11)..(11): 2'-O-methyl
  misc_feature (12)..(12): 2'-deoxy-2'-fluoro
  misc_feature (14)..(14): 2'-deoxy-2'-fluoro
  misc_feature (15)..(15): 2'-deoxy
  misc_feature (16)..(16): 2'-O-methyl
  misc_feature (17)..(18): 2'-deoxy-2'-fluoro
  misc_feature (19)..(21): 2'-O-methyl
  misc_feature (20)..(21): phosphorothioate linkage
  misc_feature (21)..(21): inverted abasic cap
gugguggacuucucucaauuu

SEQ ID NO: 403 - RNA, 21 nt, Artificial Sequence
  Synthetic
  misc_feature (1)..(1): 2'-O-methyl
  misc_feature (2)..(2): 2'-deoxy-2'-fluoro
  misc_feature (3)..(4): 2'-O-methyl
  misc_feature (6)..(6): 2'-deoxy-2'-fluoro
  misc_feature (7)..(7): 2'-O-methyl
  misc_feature (9)..(10): 2'-O-methyl
  misc_feature (11)..(13): 2'-deoxy-2'-fluoro
  misc_feature (15)..(15): 2'-deoxy-2'-fluoro
  misc_feature (16)..(17): 2'-O-methyl
  misc_feature (20)..(21): 2'-O-methyl
  misc_feature (20)..(21): phosphorothioate linkage
auugagagaaguccaccacuu

SEQ ID NO: 404 - RNA, 21 nt, Artificial Sequence
  Synthetic
  misc_feature (1)..(1): 2'-deoxy-2'-fluoro
  misc_feature (2)..(4): 2'-O-methyl
  misc_feature (6)..(6): 2'-O-methyl
  misc_feature (8)..(9): 2'-deoxy-2'-fluoro
  misc_feature (10)..(10): 2'-O-methyl
  misc_feature (11)..(14): 2'-deoxy-2'-fluoro
  misc_feature (16)..(17): 2'-O-methyl
  misc_feature (18)..(18): 2'-deoxy-2'-fluoro
  misc_feature (20)..(21): 2'-O-methyl
  misc_feature (20)..(21): phosphorothioate linkage
auugagagaaguccaccacuu

SEQ ID NO: 405 - RNA, 21 nt, Artificial Sequence
  Synthetic
  misc_feature (1)..(1): inverted abasic cap
  misc_feature (1)..(1): 2'-deoxy
  misc_feature (2)..(2): 2'-O-methyl
  misc_feature (3)..(3): 2'-deoxy
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(7): 2'-deoxy
  misc_feature (8)..(8): 2'-deoxy-2'-fluoro
  misc_feature (9)..(10): 2'-deoxy
  misc_feature (11)..(11): 2'-O-methyl
  misc_feature (12)..(12): 2'-deoxy
  misc_feature (15)..(16): 2'-deoxy
  misc_feature (18)..(18): 2'-O-methyl
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
gugguggacuucucucaauuu

SEQ ID NO: 406 - RNA, 21 nt, Artificial Sequence
  Synthetic
  misc_feature (1)..(1): inverted abasic cap
  misc_feature (2)..(2): 2'-O-methyl
  misc_feature (3)..(3): 2'-deoxy-2'-fluoro
  misc_feature (4)..(5): 2'-deoxy
  misc_feature (6)..(6): 2'-deoxy-2'-fluoro
  misc_feature (7)..(7): 2'-O-methyl
  misc_feature (8)..(8): 2'-deoxy-2'-fluoro
  misc_feature (9)..(11): 2'-deoxy
  misc_feature (13)..(13): 2'-deoxy
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 407 - RNA, 21 nt, Artificial Sequence
  Synthetic
  misc_feature (1)..(1): 2'-O-methyl
  misc_feature (2)..(2): 2'-deoxy-2'-fluoro
  misc_feature (3)..(4): 2'-O-methyl
  misc_feature (6)..(6): 2'-deoxy-2'-fluoro
  misc_feature (7)..(7): 2'-O-methyl
  misc_feature (10)..(10): 2'-deoxy-2'-fluoro
  misc_feature (11)..(11): 2'-O-methyl
  misc_feature (13)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
ugagagaaguccaccacgauu

SEQ ID NO: 408 - RNA, 21 nt, Artificial Sequence
  Synthetic
  misc_feature (1)..(1): inverted abasic cap
  misc_feature (1)..(2): 2'-O-methyl
  misc_feature (3)..(3): 2'-deoxy-2'-fluoro
  misc_feature (4)..(4): 2'-O-methyl
  misc_feature (5)..(6): 2'-deoxy-2'-fluoro
  misc_feature (8)..(8): 2'-deoxy-2'-fluoro
  misc_feature (9)..(10): 2'-deoxy
  misc_feature (11)..(11): 2'-deoxy-2'-fluoro
  misc_feature (13)..(13): 2'-deoxy
  misc_feature (14)..(14): 2'-O-methyl
  misc_feature (15)..(15): 2'-deoxy
  misc_feature (17)..(17): 2'-deoxy
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 409 - RNA, 21 nt, Artificial Sequence
  Synthetic
  misc_feature (1)..(1): 2'-O-methyl
  misc_feature (2)..(3): 2'-deoxy-2'-fluoro
  misc_feature (5)..(5): 2'-O-methyl
  misc_feature (7)..(7): 2'-deoxy-2'-fluoro
  misc_feature (8)..(13): 2'-O-methyl
  misc_feature (14)..(14): 2'-deoxy-2'-fluoro
  misc_feature (16)..(17): 2'-deoxy-2'-fluoro
  misc_feature (19)..(19): 2'-deoxy-2'-fluoro
  misc_feature (20)..(21): 2'-O-methyl
  misc_feature (20)..(21): phosphorothioate linkage
ugagagaaguccaccacgauu

SEQ ID NO: 410 - RNA, 21 nt, Artificial Sequence
  Synthetic
  misc_feature (1)..(2): 2'-deoxy-2'-fluoro
  misc_feature (3)..(4): 2'-O-methyl
  misc_feature (5)..(5): 2'-deoxy-2'-fluoro
  misc_feature (6)..(6): 2'-O-methyl
  misc_feature (7)..(8): 2'-deoxy-2'-fluoro
  misc_feature (10)..(10): 2'-deoxy-2'-fluoro
  misc_feature (11)..(13): 2'-O-methyl
  misc_feature (14)..(14): 2'-deoxy-2'-fluoro
  misc_feature (16)..(16): 2'-deoxy-2'-fluoro
  misc_feature (17)..(18): 2'-O-methyl
  misc_feature (20)..(21): 2'-O-methyl
  misc_feature (20)..(21): phosphorothioate linkage
ugagagaaguccaccacgauu

SEQ ID NO: 411 - RNA, 21 nt, Artificial Sequence
  Synthetic
  misc_feature (1)..(1): inverted abasic cap
  misc_feature (2)..(3): 2'-deoxy
  misc_feature (4)..(4): 2'-O-methyl
  misc_feature (5)..(7): 2'-deoxy-2'-fluoro
  misc_feature (8)..(9): 2'-deoxy
  misc_feature (10)..(10): 2'-deoxy-2'-fluoro
  misc_feature (11)..(11): 2'-deoxy
  misc_feature (12)..(12): 2'-O-methyl
  misc_feature (14)..(14): 2'-deoxy-2'-fluoro
  misc_feature (16)..(16): 2'-O-methyl
  misc_feature (17)..(18): 2'-deoxy
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 412 - RNA, 21 nt, Artificial Sequence
  Synthetic
  misc_feature (1)..(1): inverted abasic cap
  misc_feature (1)..(1): 2'-deoxy-2'-fluoro
  misc_feature (3)..(3): 2'-O-methyl
  misc_feature (4)..(4): 2'-deoxy-2'-fluoro
  misc_feature (5)..(6): 2'-deoxy
  misc_feature (7)..(7): 2'-O-methyl
  misc_feature (8)..(8): 2'-deoxy-2'-fluoro
  misc_feature (10)..(10): 2'-deoxy-2'-fluoro
  misc_feature (11)..(11): 2'-deoxy
  misc_feature (13)..(13): 2'-O-methyl
  misc_feature (14)..(14): 2'-deoxy
  misc_feature (16)..(16): 2'-O-methyl
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ucgugguggacuucucucauu

SEQ ID NO: 413 - RNA, 21 nt, Artificial Sequence
  Synthetic
  misc_feature (1)..(1): 2'-O-methyl
  misc_feature (2)..(3): 2'-deoxy-2'-fluoro
  misc_feature (5)..(7): 2'-deoxy-2'-fluoro
  misc_feature (9)..(9): 2'-O-methyl
  misc_feature (11)..(11): 2'-deoxy-2'-fluoro
  misc_feature (12)..(12): 2'-O-methyl
  misc_feature (13)..(14): 2'-deoxy-2'-fluoro
  misc_feature (15)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
ugagagaaguccaccacgauu

SEQ ID NO: 414 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(4): 2'-deoxy-2'-fluoro
  misc_feature (7)..(8): 2'-O-methyl
  misc_feature (9)..(11): 2'-deoxy-2'-fluoro
  misc_feature (13)..(13): 2'-O-methyl
  misc_feature (15)..(15): 2'-O-methyl
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
ugagagaaguccaccacgauu

SEQ ID NO: 415 - RNA, 21 nt, Artificial Sequence
  Synthetic
  misc_feature (1)..(1): inverted abasic cap
  misc_feature (1)..(2): 2'-deoxy
  misc_feature (5)..(5): 2'-deoxy
  misc_feature (6)..(6): 2'-deoxy-2'-fluoro
  misc_feature (8)..(8): 2'-deoxy
  misc_feature (9)..(9): 2'-deoxy-2'-fluoro
  misc_feature (10)..(11): 2'-deoxy
  misc_feature (13)..(13): 2'-deoxy-2'-fluoro
  misc_feature (14)..(14): 2'-O-methyl
  misc_feature (15)..(15): 2'-deoxy-2'-fluoro
  misc_feature (16)..(16): 2'-deoxy
  misc_feature (17)..(17): 2'-O-methyl
  misc_feature (19)..(21): 2'-O-methyl
  misc_feature (20)..(21): phosphorothioate linkage
  misc_feature (21)..(21): inverted abasic cap
ucgugguggacuucucucauu

SEQ ID NO: 416 - RNA, 21 nt, Artificial Sequence
  Synthetic
  misc_feature (1)..(1): inverted abasic cap
  misc_feature (1)..(3): 2'-deoxy-2'-fluoro
  misc_feature (4)..(4): 2'-deoxy
  misc_feature (5)..(5): 2'-deoxy-2'-fluoro
  misc_feature (6)..(7): 2'-deoxy
  misc_feature (8)..(8): 2'-deoxy-2'-fluoro
  misc_feature (9)..(11): 2'-deoxy
  misc_feature (12)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
cucgugguggacuucucucuu

SEQ ID NO: 417 - RNA, 21 nt, Artificial Sequence
  Synthetic
  misc_feature (4)..(8): 2'-O-methyl
  misc_feature (9)..(11): 2'-deoxy-2'-fluoro
  misc_feature (12)..(12): 2'-O-methyl
  misc_feature (13)..(14): 2'-deoxy-2'-fluoro
  misc_feature (15)..(15): 2'-O-methyl
  misc_feature (16)..(16): 2'-deoxy-2'-fluoro
  misc_feature (17)..(21): 2'-O-methyl
  misc_feature (20)..(21): phosphorothioate linkage
gagagaaguccaccacgaguu

SEQ ID NO: 418 - RNA, 21 nt, Artificial Sequence
  Synthetic
  misc_feature (1)..(1): inverted abasic cap
  misc_feature (1)..(3): 2'-deoxy-2'-fluoro
  misc_feature (4)..(4): 2'-deoxy
  misc_feature (5)..(5): 2'-deoxy-2'-fluoro
  misc_feature (6)..(10): 2'-deoxy
  misc_feature (11)..(11): 2'-deoxy-2'-fluoro
  misc_feature (12)..(14): 2'-deoxy
  misc_feature (15)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ccuaugggagugggccucauu

SEQ ID NO: 419 - RNA, 21 nt, Artificial Sequence
  Synthetic
  misc_feature (4)..(5): 2'-O-methyl
  misc_feature (6)..(8): 2'-deoxy-2'-fluoro
  misc_feature (9)..(9): 2'-O-methyl
  misc_feature (10)..(14): 2'-deoxy-2'-fluoro
  misc_feature (15)..(15): 2'-O-methyl
  misc_feature (16)..(16): 2'-deoxy-2'-fluoro
  misc_feature (17)..(21): 2'-O-methyl
  misc_feature (20)..(21): phosphorothioate linkage
ugaggcccacucccauagguu

SEQ ID NO: 420 - RNA, 21 nt, Artificial Sequence
  Synthetic
  misc_feature (1)..(1): inverted abasic cap
  misc_feature (1)..(5): 2'-deoxy
  misc_feature (6)..(12): 2'-deoxy-2'-fluoro
  misc_feature (13)..(13): 2'-deoxy
  misc_feature (14)..(17): 2'-deoxy-2'-fluoro
  misc_feature (18)..(18): 2'-deoxy
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
aagaacucccucgccucgcuu

SEQ ID NO: 421 - RNA, 21 nt, Artificial Sequence
  Synthetic
  misc_feature (4)..(6): 2'-O-methyl
  misc_feature (7)..(7): 2'-deoxy-2'-fluoro
  misc_feature (8)..(13): 2'-O-methyl
  misc_feature (15)..(19): 2'-deoxy-2'-fluoro
  misc_feature (20)..(21): 2'-O-methyl
  misc_feature (20)..(21): phosphorothioate linkage
gcgaggcgagggaguucuuuu

SEQ ID NO: 422 - RNA, 21 nt, Artificial Sequence
  Synthetic
  misc_feature (1)..(1): inverted abasic cap
  misc_feature (1)..(3): 2'-deoxy-2'-fluoro
  misc_feature (4)..(4): 2'-deoxy
  misc_feature (5)..(6): 2'-deoxy-2'-fluoro
  misc_feature (7)..(8): 2'-deoxy
  misc_feature (9)..(11): 2'-deoxy-2'-fluoro
  misc_feature (12)..(12): 2'-deoxy
  misc_feature (13)..(13): 2'-deoxy-2'-fluoro
  misc_feature (14)..(14): 2'-deoxy
  misc_feature (15)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ucugccgauccauacugcguu

SEQ ID NO: 423 - RNA, 21 nt, Artificial Sequence
  Synthetic
  misc_feature (4)..(5): 2'-O-methyl
  misc_feature (6)..(6): 2'-deoxy-2'-fluoro
  misc_feature (7)..(7): 2'-O-methyl
  misc_feature (8)..(8): 2'-deoxy-2'-fluoro
  misc_feature (9)..(11): 2'-O-methyl
  misc_feature (12)..(13): 2'-deoxy-2'-fluoro
  misc_feature (15)..(15): 2'-O-methyl
  misc_feature (16)..(16): 2'-deoxy-2'-fluoro
  misc_feature (17)..(21): 2'-O-methyl
  misc_feature (20)..(21): phosphorothioate linkage
cgcaguauggaucggcagauu

SEQ ID NO: 424 - RNA, 21 nt, Artificial Sequence
  Synthetic
  misc_feature (1)..(1): inverted abasic cap
  misc_feature (1)..(4): 2'-deoxy
  misc_feature (5)..(7): 2'-deoxy-2'-fluoro
  misc_feature (8)..(10): 2'-deoxy
  misc_feature (11)..(13): 2'-deoxy-2'-fluoro
  misc_feature (14)..(14): 2'-deoxy
  misc_feature (15)..(15): 2'-deoxy-2'-fluoro
  misc_feature (16)..(17): 2'-deoxy
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
agagucuagacucgugguguu

SEQ ID NO: 425 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(9): 2'-O-methyl
  misc_feature (10)..(12): 2'-deoxy-2'-fluoro
  misc_feature (13)..(13): 2'-O-methyl
  misc_feature (15)..(15): 2'-O-methyl
  misc_feature (16)..(19): 2'-deoxy-2'-fluoro
  misc_feature (20)..(21): 2'-O-methyl
  misc_feature (20)..(21): phosphorothioate linkage
caccacgagucuagacucuuu

SEQ ID NO: 426 - RNA, 21 nt, Artificial Sequence
  Synthetic
  misc_feature (1)..(1): inverted abasic cap
  misc_feature (1)..(9): 2'-deoxy
  misc_feature (10)..(16): 2'-deoxy-2'-fluoro
  misc_feature (17)..(17): 2'-deoxy
  misc_feature (18)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
gaagaagaacucccucgccuu

SEQ ID NO: 427 - RNA, 21 nt, Artificial Sequence
  Synthetic
  misc_feature (4)..(10): 2'-O-methyl
  misc_feature (11)..(19): 2'-deoxy-2'-fluoro
  misc_feature (20)..(21): 2'-O-methyl
  misc_feature (20)..(21): phosphorothioate linkage
ggcgagggaguucuucuucuu

SEQ ID NO: 428 - RNA, 21 nt, Artificial Sequence
  Synthetic
  misc_feature (1)..(1): inverted abasic cap
  misc_feature (1)..(2): 2'-deoxy-2'-fluoro
  misc_feature (3)..(5): 2'-deoxy
  misc_feature (6)..(10): 2'-deoxy-2'-fluoro
  misc_feature (11)..(13): 2'-deoxy
  misc_feature (14)..(15): 2'-deoxy-2'-fluoro
  misc_feature (16)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ucaagccuccaagcugugcuu

SEQ ID NO: 429 - RNA, 21 nt, Artificial Sequence
  Synthetic
  misc_feature (4)..(4): 2'-deoxy-2'-fluoro
  misc_feature (5)..(6): 2'-O-methyl
  misc_feature (7)..(9): 2'-deoxy-2'-fluoro
  misc_feature (10)..(13): 2'-O-methyl
  misc_feature (15)..(17): 2'-deoxy-2'-fluoro
  misc_feature (18)..(21): 2'-O-methyl
  misc_feature (20)..(21): phosphorothioate linkage
gcacagcuuggaggcuugauu

SEQ ID NO: 430 - RNA, 21 nt, Artificial Sequence
  Synthetic
  misc_feature (1)..(1): inverted abasic cap
  misc_feature (1)..(2): 2'-deoxy
  misc_feature (3)..(7): 2'-deoxy-2'-fluoro
  misc_feature (8)..(10): 2'-deoxy
  misc_feature (11)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
agccuccaagcugugccuuuu

SEQ ID NO: 431 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(9): 2'-O-methyl
  misc_feature (10)..(12): 2'-deoxy-2'-fluoro
  misc_feature (13)..(13): 2'-O-methyl
  misc_feature (15)..(17): 2'-O-methyl
  misc_feature (18)..(19): 2'-deoxy-2'-fluoro
  misc_feature (20)..(21): 2'-O-methyl
  misc_feature (20)..(21): phosphorothioate linkage
aaggcacagcuuggaggcuuu

SEQ ID NO: 432 - RNA, 21 nt, Artificial Sequence
  Synthetic
  misc_feature (1)..(1): inverted abasic cap
  misc_feature (1)..(3): 2'-deoxy
  misc_feature (4)..(6): 2'-deoxy-2'-fluoro
  misc_feature (7)..(7): 2'-deoxy
  misc_feature (8)..(8): 2'-deoxy-2'-fluoro
  misc_feature (9)..(10): 2'-deoxy
  misc_feature (11)..(11): 2'-deoxy-2'-fluoro
  misc_feature (12)..(14): 2'-deoxy
  misc_feature (15)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
agacucgugguggacuucuuu

SEQ ID NO: 433 - RNA, 21 nt, Artificial Sequence
  Synthetic
  misc_feature (4)..(5): 2'-O-methyl
  misc_feature (6)..(8): 2'-deoxy-2'-fluoro
  misc_feature (9)..(9): 2'-O-methyl
  misc_feature (10)..(11): 2'-deoxy-2'-fluoro
  misc_feature (12)..(12): 2'-O-methyl
  misc_feature (13)..(13): 2'-deoxy-2'-fluoro
  misc_feature (15)..(16): 2'-O-methyl
  misc_feature (17)..(19): 2'-deoxy-2'-fluoro
  misc_feature (20)..(21): 2'-O-methyl
  misc_feature (20)..(21): phosphorothioate linkage
agaaguccaccacgagucuuu

SEQ ID NO: 434 - RNA, 21 nt, Artificial Sequence
  Synthetic
  misc_feature (1)..(1): inverted abasic cap
  misc_feature (20)..(21): 2'-O-methyl
  misc_feature (20)..(21): phosphorothioate linkage
  misc_feature (21)..(21): inverted abasic cap
gaagaagaacucccucgccuu

SEQ ID NO: 435 - RNA, 21 nt, Artificial Sequence
  Synthetic
  misc_feature (20)..(21): 2'-O-methyl
  misc_feature (20)..(21): phosphorothioate linkage
ggcgagggaguucuucuucuu

SEQ ID NO: 436 - RNA, 21 nt, Artificial Sequence
  Synthetic
  misc_feature (1)..(1): inverted abasic cap
  misc_feature (20)..(21): 2'-O-methyl
  misc_feature (20)..(21): phosphorothioate linkage
  misc_feature (21)..(21): inverted abasic cap
agacucgugguggacuucuuu

SEQ ID NO: 437 - RNA, 21 nt, Artificial Sequence
  Synthetic
  misc_feature (20)..(21): 2'-O-methyl
  misc_feature (20)..(21): phosphorothioate linkage
agaaguccaccacgagucuuu

SEQ ID NO: 438 - RNA, 21 nt, Artificial Sequence
  Synthetic
  misc_feature (1)..(1): inverted abasic cap
  misc_feature (20)..(21): 2'-O-methyl
  misc_feature (20)..(21): phosphorothioate linkage
  misc_feature (21)..(21): inverted abasic cap
ucugccgauccauacugcguu

SEQ ID NO: 439 - RNA, 21 nt, Artificial Sequence
  Synthetic
  misc_feature (20)..(21): 2'-O-methyl
  misc_feature (20)..(21): phosphorothioate linkage
cgcaguauggaucggcagauu

SEQ ID NO: 440 - RNA, 21 nt, Artificial Sequence
  Synthetic
  misc_feature (1)..(1): inverted abasic cap
  misc_feature (20)..(21): 2'-O-methyl
  misc_feature (20)..(21): phosphorothioate linkage
  misc_feature (21)..(21): inverted abasic cap
aagaacucccucgccucgcuu

SEQ ID NO: 441 - RNA, 21 nt, Artificial Sequence
  Synthetic
  misc_feature (20)..(21): 2'-O-methyl
  misc_feature (20)..(21): phosphorothioate linkage
gcgaggcgagggaguucuuuu

SEQ ID NO: 442 - RNA, 21 nt, Artificial Sequence
  Synthetic
  misc_feature (1)..(1): inverted abasic cap
  misc_feature (20)..(21): 2'-O-methyl
  misc_feature (20)..(21): phosphorothioate linkage
  misc_feature (21)..(21): inverted abasic cap
ucaagccuccaagcugugcuu

SEQ ID NO: 443 - RNA, 21 nt, Artificial Sequence
  Synthetic
  misc_feature (20)..(21): 2'-O-methyl
  misc_feature (20)..(21): phosphorothioate linkage
gcacagcuuggaggcuugauu

SEQ ID NO: 444 - RNA, 21 nt, Artificial Sequence
  Synthetic
  misc_feature (1)..(1): inverted abasic cap
  misc_feature (20)..(21): 2'-O-methyl
  misc_feature (20)..(21): phosphorothioate linkage
  misc_feature (21)..(21): inverted abasic cap
agccuccaagcugugccuuuu

SEQ ID NO: 445 - RNA, 21 nt, Artificial Sequence
  Synthetic
  misc_feature (20)..(21): 2'-O-methyl
  misc_feature (20)..(21): phosphorothioate linkage
aaggcacagcuuggaggcuuu

SEQ ID NO: 446 - RNA, 21 nt, Artificial Sequence
  Synthetic
  misc_feature (1)..(1): inverted abasic cap
  misc_feature (20)..(21): 2'-O-methyl
  misc_feature (20)..(21): phosphorothioate linkage
  misc_feature (21)..(21): inverted abasic cap
cucgugguggacuucucucuu

SEQ ID NO: 447 - RNA, 21 nt, Artificial Sequence
  Synthetic
  misc_feature (20)..(21): 2'-O-methyl
  misc_feature (20)..(21): phosphorothioate linkage
gagagaaguccaccacgaguu

SEQ ID NO: 448 - RNA, 21 nt, Artificial Sequence
  Synthetic
  misc_feature (1)..(1): inverted abasic cap
  misc_feature (20)..(21): 2'-O-methyl
  misc_feature (20)..(21): phosphorothioate linkage
  misc_feature (21)..(21): inverted abasic cap
ccuaugggagugggccucauu

SEQ ID NO: 449 - RNA, 21 nt, Artificial Sequence
  Synthetic
  misc_feature (20)..(21): 2'-O-methyl
  misc_feature (20)..(21): phosphorothioate linkage
ugaggcccacucccauagguu

SEQ ID NO: 450 - RNA, 21 nt, Artificial Sequence
  Synthetic
  misc_feature (1)..(1): inverted abasic cap
  misc_feature (20)..(21): 2'-O-methyl
  misc_feature (20)..(21): phosphorothioate linkage
  misc_feature (21)..(21): inverted abasic cap
agagucuagacucgugguguu

SEQ ID NO: 451 - RNA, 21 nt, Artificial Sequence
  Synthetic
  misc_feature (20)..(21): 2'-O-methyl
  misc_feature (20)..(21): phosphorothioate linkage
caccacgagucuagacucuuu

SEQ ID NO: 452 - RNA, 19 nt, Artificial Sequence
  Synthetic
ugagagaaguccaccacga

SEQ ID NO: 453 - RNA, 19 nt, Artificial Sequence
  Synthetic
auugagagaaguccaccac

SEQ ID NO: 454 - RNA, 19 nt, Artificial Sequence
  Synthetic
uuccgcaguauggaucggc

SEQ ID NO: 455 - RNA, 19 nt, Artificial Sequence
  Synthetic
guuccgcaguauggaucgg

SEQ ID NO: 456 - RNA, 19 nt, Artificial Sequence
  Synthetic
gaggcauagcagcaggaug

SEQ ID NO: 457 - RNA, 19 nt, Artificial Sequence
  Synthetic
aagaugaggcauagcagca

SEQ ID NO: 458 - RNA, 19 nt, Artificial Sequence
  Synthetic
aaauugagagaaguccacc

SEQ ID NO: 459 - RNA, 19 nt, Artificial Sequence
  Synthetic
aauugagagaaguccacca

SEQ ID NO: 460 - RNA, 19 nt, Artificial Sequence
  Synthetic
gaaguccaccacgagucua

SEQ ID NO: 461 - RNA, 19 nt, Artificial Sequence
  Synthetic
aguauggaucggcagagga

SEQ ID NO: 462 - RNA, 19 nt, Artificial Sequence
  Synthetic
uccgcaguauggaucggca

SEQ ID NO: 463 - RNA, 19 nt, Artificial Sequence
  Synthetic
aacgccgcagacacaucca

SEQ ID NO: 464 - RNA, 19 nt, Artificial Sequence
  Synthetic
aguuccgcaguauggaucg

SEQ ID NO: 465 - RNA, 19 nt, Artificial Sequence
  Synthetic
ccgcguaaagagaggugcg

SEQ ID NO: 466 - RNA, 19 nt, Artificial Sequence
  Synthetic
ccgcaguauggaucggcag

SEQ ID NO: 467 - RNA, 19 nt, Artificial Sequence
  Synthetic
uugagagaaguccaccacg

SEQ ID NO: 468 - RNA, 19 nt, Artificial Sequence
  Synthetic
agaugaggcauagcagcag

SEQ ID NO: 469 - RNA, 19 nt, Artificial Sequence
  Synthetic
gaugaggcauagcagcagg

SEQ ID NO: 470 - RNA, 19 nt, Artificial Sequence
  Synthetic
aaguccaccacgagucuag

SEQ ID NO: 471 - RNA, 19 nt, Artificial Sequence
  Synthetic
augaggcauagcagcagga

SEQ ID NO: 472 - RNA, 19 nt, Artificial Sequence
  Synthetic
gagaaguccaccacgaguc

SEQ ID NO: 473 - RNA, 19 nt, Artificial Sequence
  Synthetic
ggaguuccgcaguauggau

SEQ ID NO: 474 - RNA, 19 nt, Artificial Sequence
  Synthetic
gcaguauggaucggcagag

SEQ ID NO: 475 - RNA, 19 nt, Artificial Sequence
  Synthetic
gaguuccgcaguauggauc

SEQ ID NO: 476 - RNA, 19 nt, Artificial Sequence
  Synthetic
cgaggcgagggaguucuuc

SEQ ID NO: 477 - RNA, 19 nt, Artificial Sequence
  Synthetic
aggcacagcuuggaggcuu

SEQ ID NO: 478 - RNA, 19 nt, Artificial Sequence
  Synthetic
gaggcgagggaguucuucu

SEQ ID NO: 479 - RNA, 19 nt, Artificial Sequence
  Synthetic
gagugcgaauccacacucc

SEQ ID NO: 480 - RNA, 19 nt, Artificial Sequence
  Synthetic
caguauggaucggcagagg

SEQ ID NO: 481 - RNA, 19 nt, Artificial Sequence
  Synthetic
ggcacagcuuggaggcuug

SEQ ID NO: 482 - RNA, 19 nt, Artificial Sequence
  Synthetic
aggaguuccgcaguaugga

SEQ ID NO: 483 - RNA, 19 nt, Artificial Sequence
  Synthetic
accacgagucuagacucug

SEQ ID NO: 484 - RNA, 19 nt, Artificial Sequence
  Synthetic
aggcgagggaguucuucuu

SEQ ID NO: 485 - RNA, 19 nt, Artificial Sequence
  Synthetic
ggagugcgaauccacacuc

SEQ ID NO: 486 - RNA, 19 nt, Artificial Sequence
  Synthetic
aguccaccacgagucuaga

SEQ ID NO: 487 - RNA, 19 nt, Artificial Sequence
  Synthetic
gaagaugaggcauagcagc

SEQ ID NO: 488 - RNA, 19 nt, Artificial Sequence
  Synthetic
uccaccacgagucuagacu

SEQ ID NO: 489 - RNA, 19 nt, Artificial Sequence
  Synthetic
guauggaucggcagaggag

SEQ ID NO: 490 - RNA, 19 nt, Artificial Sequence
  Synthetic
gcacuaguaaacugagcca

SEQ ID NO: 491 - RNA, 19 nt, Artificial Sequence
  Synthetic
guccaccacgagucuagac

SEQ ID NO: 492 - RNA, 19 nt, Artificial Sequence
  Synthetic
cacagcuuggaggcuugaa

SEQ ID NO: 493 - RNA, 19 nt, Artificial Sequence
  Synthetic
cugaggcccacucccauag

SEQ ID NO: 494 - RNA, 19 nt, Artificial Sequence
  Synthetic
gagagaaguccaccacgag

SEQ ID NO: 495 - RNA, 19 nt, Artificial Sequence
  Synthetic
ugaggcccacucccauagg

SEQ ID NO: 496 - RNA, 19 nt, Artificial Sequence
  Synthetic
gcgaggcgagggaguucuu

SEQ ID NO: 497 - RNA, 19 nt, Artificial Sequence
  Synthetic
cgcaguauggaucggcaga

SEQ ID NO: 498 - RNA, 19 nt, Artificial Sequence
  Synthetic
caccacgagucuagacucu

SEQ ID NO: 499 - RNA, 19 nt, Artificial Sequence
  Synthetic
ggcgagggaguucuucuuc

SEQ ID NO: 500 - RNA, 19 nt, Artificial Sequence
  Synthetic
gcacagcuuggaggcuuga

SEQ ID NO: 501 - RNA, 19 nt, Artificial Sequence
  Synthetic
aaggcacagcuuggaggcu

SEQ ID NO: 502 - RNA, 19 nt, Artificial Sequence
  Synthetic
agaaguccaccacgagucu

SEQ ID NO: 503 - DNA, 2270 bp, Hepatitis B virus
gagaacatcacatcaggatccctaggacccctgctcgtgttacaggcggggtttttcttgttgacaagaatcctcacaataccgcagagtctcgactcgtggtggacttctctcaattttctagggggatcacccgtgtgtcttggccaaaattcgcagtccccaacctccaatcactcaccaacctcctgtcctccaatttgtcctggttatcgctggatgtgtctgcggcgttttatcatattcctcttcatcctgctgctatgcctcatcttcttattggtacttctggattatcaaggtatgttgcccgtttgtcctctaattccaggaaccacaacaaccagtacgggaccctgcaaaacctgcacgactcctgctcaaggcaactctatgtttccctcatgttgctgtacaaaacctacggatggaaattgcacctgtattcccatcccatcatcttgggctttcgcaaaatacctatgggaatgggcctcagtccgtttctcatggctcagttcactagtgccatttgttcagtggttcgtagggctttcccccactgtttggctttcagttatgtggatgatgtggtattgggggccaagtctgtacaacatcttgagtccctttataccgctattaccaattttcttttgtctttgggtatacatctaaaccctaacaaaacaaagagatggggttactccctaaacttcatgggatatgtaattggaagttggggaacattaccacaggatcatattgtacaaaaacttaaacactgttttagaaaacttcctgttaataggcctattgattggaaagtatgtcaacgaattgtgggtcttttgggctttgccgctccttttacacaatgtggataccctgccttaatgcctttgtatgcatgtatacaagctaaacaggcttttactttctcgccaacttacaaggcctttctaagtaaacagtatatgaacctttaccccgttgcccggcaacggcctggtctgtgccaagtgtttgctgatgcaacccccactggctggggcttggccattggccatcagcgcatgcgcggaacctttgcggctcctctgccgatccatactgcggaactcctagcagcttgttttgctcgcagcaggtctggagcaaaactcatcgggactgataattctgtcgtcctttctcggaaatatacatcttttccatggctgctaggttgtactgccaactggattcttcgcgggacgtcctttgtttacgtcccgtcggcgctgaatcccgcggacgacccctctcggggtcgcttgggactctatcgtccccttctccgtctgccgttccagccgaccacggggcgcacctctctttacgcggtctccccgtctgtgccttctcatctgccggaccgtgtgcacttcgcttcacctctgcacgttgcatggagaccaccgtgaacgcccatcagagcctgcccaaggtcttacataagaggactcttggactctcatcaatgtcaacgaccgaccttgaagcttacttcaaagactgtgtgtttaaagactgggaagagtcgggggaggaaattaggttaaaggtttatttattaggaggctgtaggcataaattggtctgcgcaccagcaccatgcaactttttcacctctgcctaatcatctcttgtacatgtcccactgttcaagcctccaagctgtgccttgggtggctttggggcatggacattgacccctataaagaatttggagctactgtggagttactctcatttttgccttctgacttctttccttccgtccgggatctccttgataccgcctcagctctgtatcgggaagccttagagtctcctgagcattgctcacctcaccatacagcactcaggcaagccattctctgctggggggaattaatgactctagctacctgggtgggtaataatttgcaagatccagcatccagggatctagtagtcaattatgttaatactaacatgggcctaaagatcaggcaactattgtggtttcatatttcttgtcttacttttggaagagatactgtgcttgagtatttggtttctttcggagtgtggattcgcactcctcctgcctatagaccaccaaatgcccctatcttatcaacacttccggaaactactgttgttagacgaagggaccgaggtaggtcccctagaagaagaactccctcgcctcgcagacgaagatctcaatcgccgcgtcgcag

SEQ ID NO: 504 - RNA, 3221 nt, Hepatitis B virus
caugcaacuuuuucaccucugccuaaucaucucuuguacaugucccacuguucaagccuccaagcugugccuuggguggcuuuggggcauggacauugacccuuauaaagaauuuggagcuacuguggaguuacucucguuuuugccuucugacuucuuuccuuccgucagagaucuccuagacaccgccucagcucuguaucgagaagccuuagagucuccugagcauugcucaccucaccauacugcacucaggcaagccauucucugcuggggggaauugaugacucuagcuaccuggguggguaauaauuuggaagauccagcaucuagggaucuuguaguaaauuauguuaauacuaacguggguuuaaagaucaggcaacuauugugguuucauauaucuugccuuacuuuuggaagagagacuguacuugaauauuuggucucuuucggaguguggauucgcacuccuccagccuauagaccaccaaaugccccuaucuuaucaacacuuccggaaacuacuguuguuagacgacgggaccgaggcagguccccuagaagaagaacucccucgccucgcagacgcagaucuccaucgccgcgucgcagaagaucucaaucucgggaaucucaauguuaguauuccuuggacucauaaggugggaaacuuuacggggcuuuauuccucuacaguaccuaucuuuaauccugaauggcaaacuccuuccuuuccuaagauucauuuacaagaggacauuauuaauaggugucaacaauuugugggcccucucacuguaaaugaaaagagaagauugaaauuaauuaugccugcuagauucuauccuacccacacuaaauauuugcccuuagacaaaggaauuaaaccuuauuauccagaucagguaguuaaucauuacuuccaaaccagacauuauuuacauacucuuuggaaggcugguauucuauauaagcgggaaaccacacguagcgcaucauuuugcgggucaccauauucuugggaacaagagcuacagcaugggagguuggucaucaaaaccucgcaaaggcauggggacgaaucuuucuguucccaauccucugggauucuuucccgaucaucaguuggacccugcauucggagccaacucaaacaauccagauugggacuucaaccccgucaaggacgacuggccagcagccaaccaaguaggagugggagcauucgggccaaggcucaccccuccacacggcgguauuuugggguggagcccucaggcucagggcauauugaccacagugucaacaauuccuccuccugccuccaccaaucggcagucaggaaggcagccuacucccaucucuccaccucuaagagacagucauccucaggccaugcaguggaauuccacugccuuccaccaaacucugcaggaucccagagucaggggucuguaucuuccugcugguggcuccaguucaggaacaguaaacccugcuccgaauauugccucucacaucucgucaaucuccgcgaggacuggggacccugugacgaacauggagaacaucacaucaggauuccuaggaccccugcucguguuacaggcgggguuuuucuuguugacaagaauccucacaauaccgcagagucuagacucgugguggacuucucucaauuuucuagggggaucucccgugugucuuggccaaaauucgcaguccccaaccuccaaucacucaccaaccuccuguccuccaauuuguccugguuaucgcuggaugugucugcggcguuuuaucauauuccucuucauccugcugcuaugccucaucuucuuauugguucuucuggauuaucaagguauguugcccguuuguccucuaauuccaggaucaacaacaaccaguacgggaccaugcaaaaccugcacgacuccugcucaaggcaacucuauguuucccucauguugcuguacaaaaccuacggauggaaauugcaccuguauucccaucccaucguccugggcuuucgcaaaauaccuaugggagugggccucaguccguuucucuuggcucaguuuacuagugccauuuguucagugguucguagggcuuucccccacuguuuggcuuucagcuauauggaugaugugguauugggggccaagucuguacagcaucgugagucccuuuauaccgcuguuaccaauuuucuuuugucucuggguauacauuuaaacccuaacaaaacaaaaagaugggguuauucccuaaacuucaugggcuacauaauuggaaguuggggaacuuugccacaggaucauauuguacaaaagaucaaacacuguuuuagaaaacuuccuguuaacaggccuauugauuggaaaguaugucaaagaauugugggucuuuugggcuuugcugcuccauuuacacaauguggauauccugccuuaaugccuuuguaugcauguauacaagcuaaacaggcuuucacuuucucgccaacuuacaaggccuuucuaaguaaacaguacaugaaccuuuaccccguugcucggcaacggccuggucugugccaaguguuugcugacgcaacccccacuggcuggggcuuggccauaggccaucagcgcaugcguggaaccuuuguggcuccucugccgauccauacugcggaacuccuagccgcuuguuuugcucgcagccggucuggagcaaagcucaucggaacugacaauucugucguccucucgcggaaauauacaucguuuccauggcugcuaggcuguacugccaacuggauccuucgcgggacguccuuuguuuacgucccgucggcgcugaaucccgcggacgaccccucucggggccgcuugggacucucucguccccuucuccgucugccguuccagccgaccacggggcgcaccucucuuuacgcggucuccccgucugugccuucucaucugccgguccgugugcacuucgcuucaccucugcacguugcauggagaccaccgugaacgcccaucagauccugcccaaggucuuacauaagaggacucuuggacucccagcaaugucaacgaccgaccuugaggccuacuucaaagacuguguguuuaaggacugggaggagcugggggaggagauuagguuaaaggucuuuguauuaggaggcuguaggcacaaauuggucugcgcaccagcac

SEQ ID NO: 505 - RNA, 3215 nt, Hepatitis B virus
cucaacccaguuccaccaagcucuguuggaucccaggguaagggcucuguacuucccugcugguggcuccaguucagggacacagaacccugcuccgacuauugccucucucacaucaucaaucuucucgaagacugggggcccugcuaugaacauggacaacauuacaucaggacuccuaggaccccugcucguguuacaggcgguguguuucuuguugacaaaaauccucacaauaccacagagucuagacucgugguggacuucucucaauuuucuagggggacuacccggguguccuggccaaaauucgcaguccccaaccuccaaucacuuaccaaccuccuguccuccaacuuguccuggcuaucguuggaugugucugcggcguuuuaucaucuuccucuucauccugcugcuaugccucaucuucuuguugguucuucuggacuaucaagguauguugcccguuuguccucuacuuccaggauccacgaccaccagcacgggacccugcaaaaccugcacaacucuugcacaaggaaccucuauguuucccuccuguugcuguuccaaacccucggacggaaacugcacuuguauucccaucccaucauccugggcuuuaggaaaauaccuaugggagugggccucagcccguuucuccuggcucaguuuacuagugcaauuuguucaguggugcgucgggcuuucccccacuguuuggcuuuuaguuauauggaugaucugguauugggggccaaaucugugcagcaucuugagucccuuuauaccgcuguuaccaauuuucuguuaucuguggguauccauuuaaauaccucuaaaacaaaaagaugggguuacucccuacauuuuauggguuaugucauugguaguuggggaucauuaccccaagaucacauuguacacaaaaucaaggaaugcuuucgaaaacugccuguaaaucguccaauugauuggaaaguuugucaacgcauagugggucuuuugggcuuugcugccccuuucacccaaugcgguuauccugcucucaugccucuguaugccuguauuacugcuaaacaggcuuuugucuucucgccaaccuacaaggccuuucuguguaaacaauacaugaaccuuuacccgguugcucggcaacggccaggccugugccaaguguuugcugacgcaacccccacugguuggggcuuggccauuggccaucagcgcaugcguggaaccuuuguggcuccucugccgauccauacugcggaacuccuagcagcuuguuucgcucgcagcaggucuggagcgacucucaucggcacggacaauucuguuguccucucuaggaaguacaccuccuuuccauggcugcucggaugugcugcaaacuggauccugcgcgggacguccuuuguuuacgucccaucggcgcugaaucccgcggacgaccccucccggggccgcuuggggcuguaccgcccucuucuccgucugccguuccagccgacgacgggucgcaccucucuuuacgcggacuccccgucuguuccuucucaucugccggaccgugugcacuucgcuucaccucugcacgucgcauggagaccaccgugaacgcccccuggaguuugccaacagucuuacauaagcggacucuuggacuuucaggauggucaaugaccuggaucgaagaauacaucaaagacuguguauuuaaggacugggaggaguugggggaggagauuagguuaaaggucuuuguauuaggaggcuguaggcauaaauuggucuguucaccagcaccaugcaacuuuuucaccucugccuaaucaucuuuuguucaugucccacuguucaagccuccaagcugugccuuggguggcuuuggggcauggacauugacccuuauaaagaauuuggagcuucuguggaguuacucucguuuuugccuucugauuucuucccaucgguucgggaccuacucgacaccgcuucagcucuuuaccgggaugcuuuagagucaccugaacauugcacucccaaccauacugcucucaggcaagcuauuuuguguuggggugaguuaaugacuuuggcuuccugggugggcaauaauuuggaggacccugcagcuagggauuuaguaguuaacuauguuaacacuaacaugggccuaaaaauuagacaacuguugugguuucacauuuccugccuuacuuuuggaagagaaacaguucuagaguauuugguguccuuuggaguguggauucgcacuccuccugcuuacagaccaccaaaugccccuauccuauccacacuuccggaaacuacuguuguuagacgacgaggcagguccccuagaagaagaacucccucgccucgcagacgaagaucucaaucgccgcgucgccgcagaucucaaucuccagcuucccaauguuaguauuccuuggacucauaaggugggaaacuuuacggggcuuuacucuucuacugugccugcuuuuaauccuaacugguccacuccuucuuuuccugauauucauuugcaucaagaccugauuucuaaaugugaacaauuuguaggcccacuuacuaaaaaugaauuacgaagauuaaaauugguuaugccagcuagauuuuauccuaagguuaccaaauauuuucccauggauaaaggcaucaaacccuauuauccugagcaugcaguuaaucauuacuuuaaaaccagacauuauuugcauacuuuauggaaggcgggaauuuuauauaagagagaauccacacguagcgccucauuuugugggucaccauauuccugggaacaagagcuacagcaugggagcaccucucucaacgacacgaagaggcaugggacagaaucucucugugcccaauccucugggauucuuuccagaccaucagcuggauccgcuauucagagcaaauuccagcagucccgacugggacuucaacacaaacaaggacaguuggccaauggcaaacaagguaggagugggaggcuacgguccaggguucacacccccacacgguggccugcugggguggagcccucaagcacaagguguguuaacaaccuugccagcagauccgccuccugcuuccaccaaucggcgguccgggagaaagccaaccccagucucuccaccucuaagagacacacauccacaggcaaugcaguggaa

SEQ ID NO: 506 - RNA, 3182 nt, Hepatitis B virus
aacuccacaaccuuccaccaaacucugcaagaucccagagugagaggccuguauuucccugcugguggcuccaguucaggaacaguaaacccuguucugacuacugccucucccuuaucgucaaucuccgcgaggacuggggacccugcacugaacauggagaacaucacaucaggauuccuaggaccccugcucguguuacaggcgggguuuuucuuguugacaagaauccucacaauaccgcagagucuagacucgugguggacuucucucaauuuucuagggggaacuaccgugugucuuggccaaaauucgcaguccccaaccuccaaucacucaccaaccucuuguccuccaacuuguccugguuaucgcuggaugugucugcggcguuuuaucaucuuccucuucauccugcugcuaugccucaucuucuuguugguucuucuggacuaucaagguauguugcccguuuguccucuaauuccaggaucuucaacaaccagcacgggaccaugcagaaccugcacgacuccugcucaaggaaccucuauguaucccuccuguugcuguaccaaaccuucggacggaaauugcaccuguauucccaucccaucaucuugggcuuucggaaaauuccuaugggagugggccucagcccguuucuccuggcucaguuuacuagugccauuuguucagugguucguagggcuuucccccacuguuuggcuuucaguuauauggaugaugugguauugggggccaagucuguacagcaucuugagucccuuuuuaccgcuguuaccaauuuucuuuugucucuggguauacauuuaaacccuaacaaaacaaaaagaugggguuauucccuaaacuucauggguuacauaauuggaaguuggggaacguugccacaagaucauauuguacaaaagaucaaagaauguuuuagaaaacuuccuguuaacaggccuauugauuggaaaguauggcaacgaauugugggucuuuugggcuuugcugcuccauuuacacaauguggauauccugccuuaaugccuuuguaugccuguauacaagcuaaacaggcuuucacuuucucgccaacuuacaaggccuuucuaaguaaacaguacaugaaccuuuaccccguugcucggcaacggccuggucugugccaaguguuugcugacgcaacccccacuggcuggggcuuggcaauaggcaaucagcgcaugcguggaaccauuguggcuccucugccgauccauacugcggaacuccuagccgcuuguuuugcucgcagccggucuggggcaaagcucaucggaacugacaauucuguuguccucucgcggaaauauacaucguuuccauggcugcuagguuguacugccaacuggauccuucgcgggacguccuuuguuuacgucccgucggcgcugaaucccgcggacgacccuucucggggccgcuugggacucucucguccccuucuccgucugccguuccagccgaccacggggcgcaccucucuuuacgcggucuccccgucugugccuucucaucugccgguccgugugcacuucgcuucaccucugcacauugcauggagaccaccgugaacgcccaucagauuaugcccaagguuuuacauaagaggacucuuggacucccagcaaugucaacgaccgaccuugaggccuacuucaaagacuguguguuuaaggacugggaggagcugggggaggagauuagguuaaaggucuuuguauuaggaggcuguaggcauaaauuggucugcgcaccagcaccaugcaacuuuuucaccucugccuaaucaucucuuguucauguccuacuguucaagccuccaagcugugccuuggguggcuuuagggcauggacauugacccuuauaaacaauuuggagcuacuguggaguuacucccguauuugccuucugacuucuuucucuacguacgagaucuccuagauaccgccucagcucuguaucgggaagccuuagagucuccugagcauuguucaccucaccauacugcacucaggcaagcaauucuuugcuggggggaacuaaugacucuagcuaccuggguggguguuaauuuggaagauccagcaucuagagacuuaguagucaguuaugucaacacuaauaugggccuaaaguucaggcaacucuugugguuucacauuucuugucucacuuuuggaagagaaacaguuauagaguauuuggugucuuucggaguguggauucgcacuccuccagcuuauagaccaccaaaugccccuauccuaucaacacuuccggagacuacuguuguuacacgacgaggcagguccccuagaagaagaacucccucgccugccagaccaaggucucaaucgccgcgucgcagaagaucucaaucucgggaaucucaauguuaguauuccuuggacucauaagguggggaacuuuacggggcuuuauucuucuacuguuccugucuuuaauccucauuggaaaacaccuucuuuuccuaauauacauuuacaccaagacauuaucaaaaaaugugaacaauuuguaggcccacucacagucaaugagaaaagaagacugcaauugauuaugccugcuagguuuuauccaaaugucaccaaauauuugccauuggauaaggguauuaaaccuuauuauccagagcaucuaguuaaucauuacuuccaaaccagacauuauuuacacacucuauggaaggcggguauauuauauaagagagaaacaacacauagcgccucauuuugugggucaccauauucuugggaacaagagcuacagcauggggcagaaucuuuccaccagcaauccucugggauucuuucccgaccaccaguuggauccagccuucagagcaaacaccgcaaauccagauugggacuucaaucccaacaaggacaccuggccagacgccaacaagguaggagcuggagcauucgggcuggguuucaccccaccgcacggaggucuuuugggguggagcccucaggcucagggcauacuacauaccgugccagcaaauccgccuccugccucuaccaaucgccagucaggaaggcagccuaccccucugucuccaccuuugagaaacacucauccucaggccaugcagugg

SEQ ID NO: 507 - RNA, 3215 nt, Hepatitis B virus
cuccacaacauuccaccaagcucugcuagaucccagagugaggggccuauauuuuccugcugguggcuccaguuccggaacaguaaacccuguuccgacuacugccucacccauaucgucaaucuucucgaggacuggggacccugcaccgaacauggagagcacaacaucaggauuccuaggaccccugcucguguuacaggcgggguuuuucuuguugacaagaauccucacaauaccacagagucuagacucgugguggacuucucucaauuuucuagggggagcacccacguguccuggccaaaauucgcaguccccaaccuccaaucacucaccaaccucuuguccuccaacuuguccuggcuaucgcuggaugugucugcggcguuuuaucauauuccucuucauccugcugcuaugccucaucuucuuguugguucuucuggacuaccaagguauguugcccguuuguccucuacuuccaggaacaucaacuaccagcacgggaccaugcagaaccugcacgauuccugcucaaggaaccucuauguuucccucuuguugcuguacaaaaccuucggacggaaacugcacuuguauucccaucccaucauccugggcuuucgcaagauuccuaugggagugggccucaguccguuucuccuggcucaguuuacuagugccauuuguucagugguucguagggcuuucccccacuguuuggcuuucagcuauauggaugaugugguauugggggccaagucuguacaacaucuugagucccuuuuuaccucuauuaccaauuuucuuuugucuuuggguauacauuugaacccuaauaaaaccaaacguuggggcuacucccuuaacuucaugggauauguaauuggaaguugggguacuuuaccgcaggaacauauuguacaaaaacucaagcaauguuuucgaaaauugccuguaaauagaccuauugauuggaaaguaugucaaagaauugugggucuuuugggcuuugcugccccuuuuacacaauguggcuauccugccuugaugccuuuauaugcauguauacaaucuaagcaggcuuucacuuucucgccaacuuacaaggccuuucuguguaaacaauaucuaaaccuuuaccccguugcccggcaacggucaggucucugccaaguguuugcugacgcaacccccacggguuggggcuuggccauaggccaucggcgcaugcguggaaccuuuguggcuccucugccgauccauacugcggaacuccuagcagcuuguuuugcucgcagccggucuggagcgaaacuuaucggaaccgacaacucaguuguccucucucggaaauacaccuccuuuccauggcugcuaggcugugcugccaacuggauccugcgcgggacguccuuugucuacgucccgucggcgcugaaucccgcggacgacccgucucggggccguuugggccucuaccguccccuucuucaucugccguuccggccgaccacggggcgcaccucucuuuacgcggucuccccgucugugccuucucaucugccggaccgugugcacuucgcuucaccucugcacguagcauggagaccaccgugaacgcccaccaggucuugcccaaggucuuacacaagaggacucuuggacucucagcaaugucaacgaccgaccuugaggcauacuucaaagacuguuuguuuaaagacugggaggaguugggggaggagauuagguuaaaggucuuuguacuaggaggcuguaggcauaaauuggucuguucaccagcaccaugcaacuuuuuccccucugccuaaucaucucauguucauguccuacuguucaagccuccaagcugugccuuggguggcuuuggggcauggacauugacccguauaaagaauuuggagcuucuguggaguuacucucuuuuuugccuucugacuucuuuccuucuauucgagaucuccucgacaccgccucugcucuguaucgggaggccuuagagucuccggaacauuguucaccucaccauacagcacucaggcaagcuauucuguguuggggugaguugaugaaucuggccaccugggugggaaguaauuuggaagacccagcauccagggaauuaguagucagcuaugucaauguuaauaugggccuaaaaauuagacaacuauugugguuucacauuuccugccuuacuuuuggaagagaaacuguccuugaguauuuggugucuuuuggaguguggauucgcacuccucccgcuuacagaccaccaaaugccccuaucuuaucaacacuuccggaaacuacuguuguuagacgacgaggcagguccccuagaagaagaacucccucgccucgcagacgaaggucucaaucgccgcgucgcagaagaucucaaucucgggaaucucaauguuaguaucccuuggacucauaaggugggaaacuuuacugggcuuuauucuucuacuguaccugucuuuaauccugauuggaaaacucccuccuuuccucacauucauuuacaggaggacauuauuaauagaugucaacaauaugugggcccucugacaguuaaugaaaaaaggagauuaaaauuaauuaugccugcuagguucuauccuaaccuuaccaaauauuugcccuuggacaaaggcauuaaaccguauuauccugaauaugcaguuaaucauuacuucaaaacuaggcauuauuuacauacucuguggaaggcuggcauucuauauaagagagaaacuacacgcagcgccucauuuugugggucaccauauucuugggaacaagagcuacagcaugggagguuggucuuccaaaccucgacaaggcauggggacgaaucuuucuguucccaauccucugggauucuuucccgaucaccaguuggacccugcguucggagccaacucaaacaauccagauugggacuucaaccccaacaaggaucacuggccagaggcaaaucagguaggagcgggagcauuugguccaggguucaccccaccacacggaggccuuuugggguggagcccucaggcucagggcauauugacaacacugccagcagcaccuccuccugccuccaccaaucggcagucaggaagacagccuacucccaucucuccaccucuaagagacagucauccucaggccaugcaguggaa

SEQ ID NO: 508 - RNA, 3215 nt, Hepatitis B virus subtype adw
cuccaccacuuuccaccaaacucuucaagaucccagagucagggcucuguacuuuccugcugguggcuccaguucaggaacaguaagcccugcucagaauacugucucagccauaucgucaaucuuaucgaagacuggggacccugugccgaacauggagaacaucgcaucaggacuccuaggaccccugcucguguuacaggcgggguuuuucuuguugacaaaaauccucacaauaccacagagucuagacucgugguggacuucucucaauuuucuagggggaacacccgugugucuuggccaaaauucgcagucccaaaucuccagucacucaccaaccuguuguccuccaauuuguccugguuaucgcuggaugugucugcggcguuuuaucaucuuccucugcauccugcugcuaugccucaucuucuuguugguucuucuggacuaucaagguauguugcccguuuguccucuaauuccaggaucaucaaccaccagcacgggaccaugcaagaccugcacaacuccugcucaaggaaccucuauguuucccucauguugcuguacaaaaccuauggauggaaacugcaccuguauucccaucccaucaucuugggcuuucgcaaaauaccuaugggagugggccucaguccguuucucuuggcucaguuuacuagugccauuuguucagugguucguagggcuuucccccacugucuggcuuucaguuauauggaugaugugguauugggggccaagucuguacaacaucuugagucccuuuaugccgcuguuaccaauuuucuuuugucuuuggguauacauuuaaacccuaacaaaacaaaaagauggggauauucccuuaacuucaugggauauguaauugggaguuggggcacauggccacaggaucauauuguacaaaacuucaaacuauguuuuagaaaacuuccuguaaacaggccuauugauuggaaaguuugucaacgaauugugggucuuuugggguuugcugccccuuuuacgcaauguggauauccugcuuuaaugccuuuauaugcauguauacaagcaaaacaggcuuuuacuuucucgccaacuuacaaggccuuucucaguaaacaguauaugacccuuuaccccguugcucggcaacggccuggucugugccaaguguuugcugacgcaacccccacugguuggggcuuggccauaggccaucagcgcaugcguggaaccuuugugucuccucugccgauccauacugcggaacuccuagccgcuuguuuugcucgcagcaggucuggagcaaaccucaucgggaccgacaauucugucguacucucccgcaaguauacaucguuuccauggcugcuaggcugugcugccaacuggauccugcgcgggacguccuuuguuuacgucccgucggcgcugaaucccgcggacgaccccucccggggccgcuuggggcucuaccgcccgcuucuccgucugccguaccguccgaccacggggcgcaccucucuuuacgcggacuccccgucugugccuucucaucugccggaccgugugcacuucgcuucaccucugcacgucgcauggagaccaccgugaacgcccaccggaaccugcccaaggucuugcauaagaggacucuuggacuuucagcaaugucaacgaccgaccuugaggcauacuucaaagacuguguguuuaaugagugggaggagcugggggaggagauuagguuaaaggucuuuguacucggaggcuguaggcauaaauuggucuguucaccagcaccaugcaacuuuuucaccucugccuagucaucucuuguucauguccuacuguucaagccuccaagcugugccuuggguggcuuuggggcauggacauugaccccuauaaagaauuuggagcuacuguggaguuacucucuuuuuugccuucugacuucuuuccgucggugcgggaccuccuagauaccgucucugcucuguaucgggaagccuuaaaaucuccugagcauugcucaccucaccacacagcacucaggcaagcuauucugugcuggggggaauuaaugacucuagcuaccuggguggguaauaauuuggaagauccagcaucccgggaucuaguagucaauuauguuaacacuaacaugggccuaaagaucaggcaacuauggugguuucacauuuccugucuuacuuuuggaagagaaacuguucuggaauauuugguaucuuuuggaguguggauucgcacuccuccugccuacagaccaccaaaugccccuaucuuaucaacacuuccggaaacuacuguuguuagacgacgaggcagguccccuagaagaagaacucccucgccucgcagacgaaggucucaaucaccgcgucgcagaagaucucaaucucgggaaucccaauguuaguaucccuuggacucauaaggugggaaacuuuacggggcuuuauucuucuacaguaccugucuuuaauccugaauggcaaacuccuucuuuuccagacauucauuuacaggaggacauuguugauagauguaagcaauuugugggaccccuuacaguaaaugaaaacaggagacuaaaauuaauaaugccugcuagauuuuaucccaauguuaccaaauauuugcccuuagauaaagguaucaaaccuuauuauccagagcauguaguuaaucauuacuuccagacuagacauuauuugcauacucuuuggaaggcggguaucuuauauaaaagagagucaacacauagcgccucauuuugcgggucaccuuauucuugggaacaagaucuacagcaugggagguuggucuuccaaaccucgaaaaggcauggggacaaaucuuucuguccccaauccccugggauucuuccccgaucaucaguuggacccugcauucaaagccaacucagaaaauccagauugggaccucaacccacacaaggacaacuggccggacgcccacaaggugggagugggagcauucgggccaggauucaccccuccccaugggggacuguugggguggagcccucaggcucagggcauacucacaucugugccagcagcuccuccuccugccuccaccaaucggcagucaggacggcagccuacuccccuaucuccaccucuaagggacacucauccucaggccaugcaguggaa

SEQ ID NO: 509 - RNA, 3182 nt, Hepatitis B virus
aacuccacaaccuuccaccaaacucugcaagaucccagagugagaggccuguaucucccugcugguggcuccaguucaggaacaguaaacccuguuccgacuacugucucucccauaucgucaaucuucucgaggauuggggacccugcgcugaacauggagaacaucacaucaggauuccuaggaccccugcucguguuacaggcgggguuuuucuuguugacaaaaauccucacaauaccgaagagucuagacucgugguggacuucucucaauuuucuagggggaaccaccgugugucuuggccaaaauucgcaguccccaaccuccaaucacucaccaaccuccuguccuccaacuuguccugguuaucgcuggaugugucugcggcguuuuaucaucuuccucuucauccugcugcuaugccucaucuucuuguugguucuucuggacuaucaagguauguugcccguuuguccucugauuccaggaucuucaaccaccagcacgggaccaugcagaaccugcacgacuccugcucaaggaaccucuauguaucccuccuguugcuguaccaaaccuucggacggaaauugcaccuguauucccaucccaucauccugggcuuucggaaaauuccuaugggagugggccucagcccguuucuccuggcucaguuuacuagugccauuuguucagugguucguagggcuuucccccacuguuuggcuuuuaguuauauggaugaugugguauugggggccaaaacuguucaccaucuugagucccuuuuuaccgcuguuaccaauuuucuuuugucuuuggguauacaucuaaacccuaacaaaacaaaaagaugggguuacucuuuacauuuuaugggcuaugucauuggauguuaugggucuuugccacaagaucacaucauacagaaaaucaaagaauguuuuagaaaacuuccuguuaacaggccuauugauuggaaagucugucaacguauugugggucuuuugggauuugcugcuccuuuuacacaaugugguuauccugcuuuaaugcccuuguaugcauguauucaaucuaagcaggcuuucacuuucucgccaacuuacaaggccuuucuguguaaacaauaccugaaccuuuaccccguugcccggcaacgcccaggucugugccaaguguuugcugacgcaacccccacuggcuggggcuuggucaugggccaucagcgcaugcguggaaccuuucaggcuccucugccgauccauacugcggaacuccuagccgcuuguuuugcucgcagccggucuggagcaaacauucucgggacggauaacucuguuguucucucccgcaaauauacgucguuuccauggcugcuaggcugugcugccaacuggauccugcgcgggacguccuuuguuuacgucccgucggcgcugaaucccgcggacgacccuucucggggccgcuugggacucucucguccccuucuccgucugccguuucgaccgaccacggggcgcaccucucuuuacgcggacuccccgucugugccuucucaucugccggaccgugugcacuucgcuucaccucugcacgucgcauggagaccaccgugaacgcccaccaauucuugcccaaggucuuacauaagaggacucuuggacucucuguaaugucaacgaccgaccuugaggcauacuucaaagacuguuuguuuaaggacugggaggagucgggggaggagauuagauuaaugaucuuuguacuaggaggcuguaggcauaaauuggucugcgcaccagcaccaugcaacuuuuucaccucugccuaaucaucucuuguucauguccuacuguucaagccuccaagcugugccuuggguggcuuuaggacauggacauugauccuuauaaagaauuuggagcuacuguggaguuacucucguuucugccuucugacuucuuuccuucaguacgagaucuucuagauaccgccucagcucuauaucgggaagccuuagaaucuccugagcauuguucaccucaccauacugcacucaggcaagcaauucucugcuggggggaucuaauaacucuauccaccugggugggugguaauuuggaagauccaacaucuagggaccuaguagucaguuauguuaacacuaauaugggccuaaaguucaggcaacuauugugguuucacauuucuugucucacuuuuggaagagaaacggucauagaguauuuggugucuuuuggaguguggauucgcacuccuccagcuuauagaccaccaaaugccccuaucuuaucaacacuuccggagacuacuguuguuagacgacgaggcagguccccuagaagaagaacucccucgccucgcagacgaaggucucaaucgccacgucgcagaagaacucaaucucgggaaucucaauguuaguauucccuggacucauaaggugggaaacuuuacggggcuuuauucuucuacuguuccugucuuuaacccucauuggaaaacacccucuuuuccuaauauacauuuacaccaagacauuaucaaaaaaugugaacaauuuguaggcccacucacagucaaugagaaaagaagacugcaauugauuaugccugcuagguuuuauccaaagguuaccaaauauuugccauuggauaaggguauuaaaccuuauuauccagaacaucuaguuaaucauuacuuccaaaccagacauuauuuacacacucuauggaaggcggguguauuauauaagagagaaacuacacauagcgccucauuuugugggucaccauauuccugggaacaagagcuacagcauggggcagaaucuuuccaccagcaauccucugggauucuuucccgaccaccaguuggauccagccuucagagcaaacacugcaaauccagauugggacuucaaucccaacaaggacuccuggccagacgccaacaagguaggagcuggagcauucgggcugggauucaccccaccgcacggaggccuuuugggguggagcccucaggcucagggcauacuacaaaccuugccagcaaauccgccuccugccuccaccaaucgccagucaggaaggcaaccuaccccucugucuccaccuuugagaaacacucauccucaggccaugcagugg

SEQ ID NO: 510 - RNA, 3212 nt, Hepatitis B virus
uuccacaacauuccaccaagcucugcaggaucccagaguaagaggccuguauuuuccugcugguggcuccaguuccggaacagugaacccuguuccgacuacugccucacucaucucgucaaucuucucgaggauuggggacccugcaccgaacauggaaagcaucacaucaggauuccuaggaccccugcucguguuacaggcgggguuuuucuuguugacaaaaauccucacaauaccgcagagucuagacucgugguggacuucucucaauuuucuagggggagcucccgugugucuuggccaaaauucgcaguccccaaccuccagucacucaccaaccucuuguccuccaauuuguccuggcuaucgcuggaugugucugcggcguuuuaucaucuuccucuucauccugcugcuaugccucaucuucuuguugguucuucuggacuaucaagguauguugcccguuuguccucuaauuccaggaucaucaaccaccaguacgggacccugccgaaccugcacgacucuugcucaaggaaccucuauguuucccucauguugcuguucaaaaccuucggacggaaauugcacuuguauucccaucccaucaucaugggcuuucggaaaauuccuaugggagugggccucagcccguuucuccuggcucaguuuacuagugccauuuguucagugguucgccgggcuuucccccacugucuggcuuucaguuauauggaugaugugguauugggggccaagucuguacaacaucuugagucccuuuauaccgcuguuaccaauuuucuuuugucuuuggguauacauuuaaaucccaacaaaacaaaaagauggggcuauucccuuaauuucauggguuauguaauuggaaguuggggcucauuaccacaggaacacaucauacaaaaaaucaaagacuguuuuagaaaacucccuguuaaccggccuauugauuggaaaguaugucaaagaauugugggucuuuugggcuuugcugcccccuuuacacaauguggauauccugcuuuaaugccucuguaugcauguacucaaucuaagcaggcuuucacuuucucgccaacuuacaaggccuuucuguguaaacaauaccugaaccuuuaccccguugcccggcaacggccaggucugugccaaguguuugcugaugcaacccccacuggcuggggcuuggccauaggcauucagcgcaugcgcggaaccuuuguggcuccucugccgauccauacugcggaacuccuagccgcuuguuuugcucgcagcaggucuggagcaaaacuuaucgggaccgauaauucugucguucucucccggaaguauacauccuuuccauggcugcuaggcugugcugccaacuggauccugcgagggacguccuuugucuacgucccgucagcgcugaauccugcggacgacccgucucggggucgcuuggggaucuaucguccccuucuccgucugccguuccagccgaccacggggcgcaccucucuuuacgcggucuccccgucuguuccuucucaucugccggaccgugugcacuucgcuucaccucugcacgucgcauggagaccaccgugaacgcccaccaaauauugcccaaggucuuacauaagaggacucuuggacucucugcaaugucaacgaccgaccuugaggcauacuucaaagacuguuuguuuaaagacugggaggagucgggggaggagauuagauuaaaggucuuuguacuaggaggcuguaggcauaaauuggucugcgcaccagcaccaugcaacuuuuucaccucugccuaaucaucucuuguucauguccuacuguucaagccuccaagcugugccuuggguggcuuuggggcauggacauugacccuuauaaagaauuuggagcuacuguggaguuacucucguuuuugccuucugacuucuuuccuucaguaagagaucuucuagauaccgccucagcucuguaucgggaugccuuagagucuccugagcauuguucaccucaccacacugcacucaggcaagccauucuuugcuggggagaacuaaugacucuagcuaccuggguggguguaaauuuggaagauccagcauccagggaccuaguagucaguuaugucaauacuaauaugggccuaaaguucaggcaauuauugugguuucacauuucuugucucacuuuuggaagagaaaccgucauagaguauuuggugucuuuuggaguguggauucgcacuccuccagcuuauagaccaccaaaugccccuaucuuaucaacacuuccggagaauacuguuguuagacgaagaggcagguccccuagaagaagaacucccucgccucgcagacgaagaucucaaucgccgcgucgcagaagaucucaaucuccagcuucccaauguuaguauuccuuggacucauaaggugggaaauuuuacggggcuuuacucuucuacuauaccugucuuuaauccuaacuggaaaacuccaucuuuuccugauauucauuugcaccaggacauuauuaacaaaugugaacaauuuguagguccucuaacuguaaaugaaaaacgaagauuaaacuuagucaugccugcuagauuuuuucccaucucuacgaaauauuugccccuagagaaagguauaaaaccuuauuauccagauaauguaguuaaucauuacuuccaaaccagacacuauuuacauacccuauggaaggcgggcaucuuauauaaaagagaaacuacacguagcgccucauuuugugggucaccuuauucuugggaacaagagcuacaucauggggcuuucuuggacggucccucucgaaugggggaagaauauuuccaccaccaauccucugggauuuuuucccgaccaccaguuggauccagcauucagagcaaacaccagaaauccagauugggaccacaaucccaacaaagaccacuggacagaagccaacaagguaggagugggagcauucgggccuggguucacucccccacacggaggccuuuugggguggagcccucaggcucaaggcaugcuaaaaacauugccagcagauccgccuccugccuccaccaaucggcagucaggaaggcagccuaccccaaucacuccaccuuugagagacacucauccucaggccaugcaguggaa

SEQ ID NO: 511 - RNA, 3215 nt, Hepatitis B virus
cucgaggacuggggacccugcaccgaacauggagagcacaacaucaggauuccuaggaccccugcucguguuacaggcgggguuuuucuuguugacaagaauccucacaauaccacagagucuagacucgugguggacuucucucaauuuucuagggggagcacccacguguccuggccaaaauucgcaguccccaaccuccaaucacucaccaaccucuuguccuccaauuuguccugguuaucgcuggaugugucugcggcguuuuaucauauuccucuucauccugcugcuaugccucaucuucuuguugguucuucuggacuaccaagguauguugcccguuuguccucuacuuccaggaacaucaacuaccagcacgggaccaugcaagaccugcacgauuccugcucaaggaaccucuauguuucccucuuguugcuguacaaaaccuucggacggaaacugcacuuguauucccaucccaucauccugggcuuucgcaagauuccuaugggagugggccucaguccguuucuccuggcucaguuuacuagugccauuuguucagugguucgcagggcuuucccccacuguuuggcuuucaguuauauggaugaugugguauugggggccaagucuguacaacaucuugagucccuuuuuaccucuauuaccaauuuucuuuugucuuuggguauacauuugaacccuaauaaaaccaaacguuggggcuacucccuuaacuucaugggauauguaauuggaaguugggguacuuuaccacaggaacauauuguauuaaaacucaagcaauguuuucgaaaacugccuguaaauagaccuauugauuggaaaguaugucaaagaauugugggucuuuugggcuuugcugccccuuuuacacaauguggcuauccugccuugaugccuuuguaugcauguauacaaucuaagcaggcuuucacuuucucgccaacuuauaaggccuuucugugucaacaauaccugcaccuuuaccccguugcccggcaacggucaggucucugccaaguguuugcugacgcaacccccacuggauggggcuuggccauaggccaucggcgcaugcguggaaccuuugugguuccucugccgauccauacugcggaacuccuagcagcuuguuuugcucgcgaccggucuggagcaaaacuuaucgggacugacaacucgguuguccucucucggaaauacaccuccuucccauggcugcucgggugugcugccaacuggauccugcgcgggacguccuuugucuacgucccgucggcgcugaaucccgcggacgacccgucucggggccguuugggccucuaccgucccuugcuuucucugccguuccagccgaccacggggcgcaccucucuuuacgcggucuccccgucugugccuucucaucugccggaccgugugcacuucgcuucaccucugcacgucgcauggagaccaccgugaacggccaccaggucuugcccaagcucuuacauaagaggacucuuggacucucagcaaugucaacaaccgaccuugaggcauacuucaaagacuguuuguuuaaagacugggaggaguugggggaggagauuagguuaaaggucuuuguacuaggaggcuguaggcauaaauuggucuguucaccagcaccaugcaacuuuuucaccucugccuaaucaucucauguucauguccuacuguucaagccuccaagcugugccuuggguggcuuuggggcauggacauugacccguauaaagaauuuggagcuucuguggaguuacucucuuuuuugccuucugacuucuuuccuucuauucgagaucuccucgacaccgccucugcucuguaucgggaggccuuagagucuccggaacauuguucaccucaccauacagcacucaggcaagcuauucuguguuggggugaguugaugaauuuggccaccugggugggaaguaauuuggaagacccagcauccagggaauuaguagucagcuaugucaauguuaauaugggccuaaaaaucagacaacuauugugguuucauauuuccugucuuacuuuuggaagagaaacuguucuugaguauuuggugucuuuuggaguguggauucgcacuccucccgcuuacagaccaccaaaugccccuaucuuaucaacacuuccggaaacuacuguuguuagacgacgaggcagguccccuagaagaagaacucccucgccucgcagacgaaggucucaaucgccgcgucgcagaagaucucaaucucgggaaucucaauguuaguaucccuuggacucauaaggugggaaacuuuacugggcuuuauucuucuacuguaccuguccuuaauccugagucccaaacucccuccuuuccuaacauucauuuacaggaggacauuauuaauagaugucaacaauaugugggcccucuuacaguuaaugaaaaaaggagauuaaaauuaauuaugccugcuagguucuauccuaaccuuaccaaauauuugcccuuggauaaaggcauuaaaccuuauuauccugaacaugcaguuaaucauuacuucaaaacuaggcauuauuuacauacucuguggaaggcuggcauucuauauaaaagagaaacuacacgcagcgcuucauuuugugggucaccauauucuugggaacaagagcuacggcaugggagguuggucuuccaaaccucgacaaggcauggggacgaaucuuucuguucccaauccucugggauucuuucccgaucaccaguuggacccugcguucggagccaacucaaacaauccagauugggacuucaaccccaacaaggaucacuggccagaggcaaucaagguaggagcgggagacuucgggccaggguucaccccaccacacggcggucuuuugggguggagcccucaggcucagggcauauugacaacagugccagcagcgccuccuccuguuuccaccaaucggcagucaggaagacagccuacucccaucucuccaccucuaagagacagucauccucaggccaugcaguggaacuccacaacauuccaccaagcucugcuagaucccagagugaggggccuauauuuuccugcugguggcuccaguuccggaacaguaaacccuguuccgacuacugucucacccauaucgucaaucuu

SEQ ID NO: 512 - RNA, 3182 nt, Hepatitis B virus
aacuccacaaccuuccaacacacucugcaagaucccagagugaaaggccuguaucucccugcugguggcuccaguucaggaacaguaaacccuguuccgaccacugccucucccuuaucgucaaucuucucgaggauuggggacccugcgcugaacauggagaacaucacaucaggauuccuaggaccccuucucguguuacaggcgggguuuuucuuguugacaagaauccucacaauaccgcagagucuagacucgugguggacuucucucaauuuucuagggggaacuaccgugugucuuggccaaaauucgcaguccccaaccuccaaucacucaccaaccuccuguccuccaacuuguccugguuaucgcuggaugugucugcggcguuuuaucaucuuccucuucauccugcugcuaugccucaucuucuuguugguucuucuggacuaucaagguauguugcccguuuguccucuaauuccaggauccucaaccaccagcacgggaccaugccgcaccugcacgacuccugcucaaggaaccucuauguaucccuccuguugcuguaccaaaccuucggacggaaauugcaccuguauucccaucccaucaucuugggcuuucggaaaauuccuaugggagugggccucagcccguuucuccuggcucaguuuacuagugccauuuguucagugguucguagggcuuucccccacuguuuggcuuucaguuauauggaugaugugguauugggggccaagucuguacagcaucuugagucccuuuuuaccgcuguaaccaauuuucuucugucuuuggguauacauuuaaacccuaacaaaacaaagagaugggguuacucucuaaauuuuaugggguauaucauuggaugucauggguccuugccacaagaacacaucguacaaaaaaucaaagaauguuuuaggaaacuuccuauuaacaggccuauugauuggaaagugugucaacgaauugugggucuuuuggguuuugcugccccuuuuacacaaugugguuacccugcuuuaaugcccuuguaugcauguauccaaucuaagcaggcuuucacuuucucgucaacuuacaaggccuuucuguguaaacaauaccugaaccuuuaccccguugcccggcaacggccaggucugugccaaguguuugcugacgcaacccccacugguuggggcuuggccaugggccaucagcgcaugcguggaaccuuucuggcuccucugccgauccauacugcggaacuccuagccgcuuguuuugcucgcagcaggucuggagcaaacauuaucgggacugauaacucuguuguccucucccgcaaauauacaucguuuccauggcugcuaggcugugcugccaacuggauccugcgcgggacguccuuuguuuacgucccgucggcgcugaaucccgcggacgaccccucucggggucgcuugggacuuucucguccccuucuccgucugccguuccgaccgaccacggggcgcaccucucuuuacgcggacuccccgucugugccuucucaucugccggaccgagugcacuuagguucaccucugcacgucgcauggagaccaccgugaacgcccaccaaaucuugcccaaggucuuacauaagaggacucuuggacuuucugcaaugucaacgaccgaccuugaggcauacuucaaagacuguuuguuuaaagacugggaggaguugggggaggagauuugguuaaaggucuuuguacuaggaggcuguaggcauaaauuggucugcgcaccagcaccaugcgacuuuuucaccucugccuaaucaucucuuguucauguccuacuguucaagccucuaagcugugccuuagguggcuuuagggcauggacauugacccuuauaaagaauuuggagcuucuguggaguuacucucguuuuugccuucugacuucuuuccuucaguacgagaucuucuagauaccgccucagcucuguaucgggaagccuuagagucuccugagcacuguacaccucaccauacugcacucaggcaagcaauucuuugcuggggggaccuaaugacucuagcuaccuggguggguguuaauuuggaagauccagcaucuagagaccuaguaguuaguuaugucaacacuaauaugggccuaaaguucaggcaacuuuugugguuucacguuucuugucucacuuuuggaagagaaacaguuguagaguauuuggugucuuucggaguguggauucgcacuccuccagcuuauagaccaccaaaugccccuauccuaucaacacuuccggagacuacuguuguuagacgacgaugcagguccccuagaagaagaacucccucgccucgcagacgaaggucucaaucgccgcgucgcagaagaucucaaucucgggaaucucaauguuaguauuccuuggacucauaagguggggaacuuuacugggcuuuauucuucuacuguaccugucuuuaauccucauuggaaaacaccaucuuuuccuaauauacauuuacaccaagacauuaucaaaaaaugugaacaguuuguaggcccacucacaguuaaugagaaaagaagauugcaauugauuaugccugcuagguuuuauccaaauguuaccaaauauuuaccauuggauaaggguauuaaaccuuauuauccagaacaucuaguuaaucauuacuuccaaacuagacacuauuuacacacucuauggaaggcggguauauuauauaagagagaaacaacacauagcgccucauuuugugggucaccauauucuugggaacaagaucuacagcauggggcagaaucuuuccaccagcaauccucugggauucuuucccgaccaccaguuggauccagccuucagagcaaacaccgcaaauccagauugggacuucaaucccaacaaggacaccuggccagaugccaacaagguaggagcuggagcauucgggcuggguuucaccccaccgcacggaggccuuuugggauggagcccucaggcucagggcauacuacuaacuuugccagcaaauccgccuccugccuccaccaaucgccagucaggcaggcagccuaccccgcugacuccaccuuugagaaacacucauccucaggccaugcagugg

SEQ ID NO: 513 - RNA, 3221 nt, Hepatitis B virus
uuccacugccuuccaccaagcucugcaagaccccagagucaggggucuguauuuuccugcugguggcuccaguucaggaacaguaaacccugcuccgaauauugccucucacaucucgucaaucuccgcgaggaccggggacccugugacgaacauggagaacaucacaucaggauuccuaggaccccugcccguguuacaggcgggguuuuucuuguugacaagaauccucacaauaccgcagagucuagacucgugguggacuucucucaauuuucuagggggaucacccgugugucuuggccaaaauucgcgauccccaaccuccaaucacucaccaaccuccuguccuccaauuuguccugguuaucgcuggaugugucugcggcguuuuaucauauuccucuucauccugcugcuaugccucaucuucuuauugguucuucuggauuaucaagguauguugcccguuuguccucuaauucuaggaucaacaacaaccaguacgggaccaugcaaaaccugcacgacuccugcucaaggcaacucuauguuucccucauguugcuguacaaaaccuacggauggaaauugcaccuguauucccaucccaucgucuugggcuuucgcaaaauaccuaugggagugggccucaguccguuucucuuggcucaguuuacuagugccauuuguucagugguucguagggcuuucccccacuguuuggcuuucagcuauauggaugaugugguauugggggccaagucuguacagcaucgugaguuccuuuauaccgcuguuaccaauuuucuuuugucucuggguauacauuuaaacccuaacaaaacaaaaagaugggguuauucccuaaacuucauggguuauguaauuggaaguuggggaacauugccacaggaucauauuguacaaaaaaucaaacacuguuuuagaaaacuuccuguuaacaggccuauugauuggaaaguaugucaaagaauugugggucuuuugggcuuugcugcuccuuuuacacaauguggauauccugccuuaaugcccuuguaugcauguauacaagcuaaacaggcuuucacuuucucgccaacuuacaaggccuuucuaaguaaacaguacaugaaccuuuaccccguugcucggcaacggccuggucugugccaaguauuugcugaugcaacccccacuggcuggggcuuggccauaggccaucagcgcaugcgcggaaccuuuguggcuccucugccgauccauacugcggaacuccuagccgcuuguuuugcucgcagccggucuggagcgaaacucaucggaacugacaauucugucguccucucgcggaaauauaccucguuuccauggcuacuaggcugugcugccaacuggauccuucgcgggacguccuuuguuuacgucccgucggcgcugaaucccgcggacgaccccucucggggccgcuugggacucucucguccccuucuccgucugccguuccagccgaccacggggcgcaccucucuuuacgcggucuccccgucugugccuucucaucugccgguccgugugcacuucgcuucaccucugcacguugcauggagaccaccgugaacgcccaucagauccugcccaaggucuuacauaagaggacucuuggacucccagcaaugucaacgaccgaccuugaggccuacuucaaagacuguguguuuaaggacugggaggagcugggggaggagauuagguuaaaggucuuuguauuaggaggcuguaggcauaaauuggucugcgcaccagcaccaugcaacuuuuucaccucugccuaaucaucucuuguacaugucccacuguucaagccuccaagcugugccuuggguggcuuuggggcauggacauugacccuuauaaagaauuuggagcuacuguggaguuacucucguuuuugccuucugacuucuuuccuuccgucagagaucuccuagacaccgccucggcucuguaucgggaagccuuagagucuccugagcauugcucaccucaccauaccgcacucaggcaagccauucucugcuggggggaauugaugacucuagcuaccuggguggguaauaauuuggaagauccagcauccagggaucuaguagucaauuauguuaauacuaacaugggauuaaagaucaggcaacucuugugguuucauaucucuugccuuacuuuuggaagagaaacuguacuugaauauuuggucucuuucggaguguggauucgcacuccuccagccuauagaccaccaaaugccccuaucuuaucaacacuuccggaaacuacuguuguuagacgacgggaccgaggcagguccccuagaagaagaacucccucgccucgcagacgcagaucucaaucgccgcgucgcagaagaucucaaucucgggaaucucaauguuaguauuccuuggacucauaaggugggaaacuucacugggcuuuauuccucuacagcaccuaucuuuaauccugaauggcaaacuccuuccuuuccuaaaauucauuuacaagaggacauuauuaauaggugucaacaauuugugggcccucucacuguaaaugaaaagagaagauugaaauuaauuaugccugcuagauucuauccuacccacacuaaauauuugcccuuagacaaaggaauuaaaccuuauuauccagaucagguaguuaaucauuacuuccaaaccagacauuauuuacauacucuuuggaaggcggguauucuauauaagagagaaaccacacguagcgcaucauuuugcgggucaccauauucuugggaacaagagcuacagcaugggagguuggucaucaaaaccucgcaaaggcauggggacgaaucuuucuguucccaacccucugggauucuuucccgaucaucaguuggacccuguauucggagccaacucaaacaauccagauugggacuucaaccccaucaaggaccacuggccagcagccaaccagguaggagugggagcauucgggccaggguucaccccuccacacggcgguguuuugggguggagcccucaggcucagggcauguugaccccagugucaacaauuccuccuccugccuccgccaaucggcagucaggaaggcagccuacucccaucucuccaccucuaagagacagucauccucaggccaugcaguggaa

SEQ ID NO: 514 - RNA, 3215 nt, Hepatitis B virus
  misc_feauure (2768)..(2768): n is a, c, g, or u
cuccaccacauuccaccaagcucugcuacaccccagaguaaggggccuauacuuuccugcugguggcuccaguuccggaacaguaaacccuguuccgacuacugccucucccauaucgucaaucuucucgaggacuggggacccugcaccgaacauggagaacacaacaucaggauuccuaggaccccugcucguguuacaggcgggguuuuucuuguugacaagaauccucacaauaccacagagucuagacucgugguggacuucucucaauuuucuagggggagcacccacguguccuggccaaaauucgcaguccccaaccuccaaucacucaccaaccucuuguccuccaauuuguccuggcuaucgcuggaugugucugcggcguuuuaucauauuccucuucauccugcugcuaugccucaucuucuuguugguucuucuggacuaccaagguauguugcccguuuguccucuacuuccaggaacaucaacuaccagcacgggaccaugcaagaccugcacgauuccugcucaaggcaccucuauguuucccucuuguugcuguacaaaaccuucggacggaaacugcacuuguauucccaucccaucauccugggcuuucgcaagauuccuaugggagugggccucaguccguuucuccuggcucaguuuacuagugccauuuguucagugguucguagggcuuucccccacuguuuggcuuucaguuauauggaugaugugguauugggggccaagucuguacaacaucuugagucccuuuuuaccgcuguuaccaauuuucuuuugucuuuggguauacauuugaacccuaauaaaaccaaacguugggguuacucccuuaacuucaugggauauguaauuggaaguugggguacuuuaccgcaagaccauauuguacuaaaaaucaagcaauguuuucgaaaacugccuguaaauagaccuauugauuggaaaguaugucagagaauugugggucuuuugggcuuugcugccccuuuuacacaauguggcuauccugccuuaaugccuuuauaugcauguauacaaucuaagcaggcuuucacuuucucgccaacuuacaaggccuuucuguguaaacaauaucugaaccuuuaccccguugcccggcaacggucaggucucugccaaguguuugcugacgcaacccccacuggauggggcuuggcuauuggccaucgccgcaugcguggaaccuuuguggcuccucugccgauccauacugcggaacuccuagcagcuuguuuugcucgcagccggucuggagcgaaacugaucggaacggacaacucuguuguucucucucggaaauacaccuccuuuccauggcugcuagggugugcugccaacuggauccugcgcgggacguccuuuguuuacgucccgucggcgcugaaucccgcggacgacccaucucggggccguuugggucucuaccguccccuucuucaucugccguuccggccgaccacggggcgcaccucucuuuacgcggucuccccgucugugccuucucaucugccggaccgugugcacuucgcuucaccucugcacgucgcauggagaccaccgugaacgcccaccaggucuugcccaaggucuuauauaagaggacucuuggacucucagcaaugucaacgaccgaccuugaggcauacuucaaagacuguuuguuuaaggacugggaggaguugggggaggagauuagguuaaugaucuuuguacuaggaggcuguaggcauaaauuggucuguucaccagcaccaugcaacuuuuucaccucugccuaaucaucucauguucauguccuacuguucaagccuccaagcugugccuuggguggcuuuaggacauggacauugacccauauaaagaauuuggagcuucuguggaguuacucucuuuuuugccuucugacuuuuuuccuucuauucgagaucuccucgacaccgccucugcucuguaucgggaggccuuagagucuccggaacauuguucaccucaccauacagcacucagacaagccauucuguguuggggugaguugaugaaucuggccaccugggugggaaguaauuuggaagacccagcauccagggaauuaguagucagcuaugucaauguuaauaugggccuaaaaaucagacaacuacugugguuucacauuuccugucuuacuuuuggaagagaaacuguucuugaguauuuggugucuuuuggaguguggauucgcacuccuccugcuuacagaccaucaaaugccccuaucuuaucaacacuuccggaaacuacuguuguuagacgacgaggcagguccccuagaagaagaacucccucgccucgcagacgaaggucucaaucgccgcgucgcagaagaucucaaucucgggaaccucaauguuaguaucccuuggacucauaaggugggaaacuuuacugggcuuuauucuucuacuguaccugucuuuaauccugaguggcaaacucccucuuuuccucauauucauuugcaggaggacauuauuaauagaugucaacaauaugugggcccucuuacaguuaaugaaaaaaggagauuaaaauuaauuaugccugcuagguucuauccuaaccuuaccaaauauuugcccuuggacaaaggcauuaaaccauauuauccggaacaugcaguuaaucauuacuucaaaacuaggcauuauuuacauacucuguggaaggcnggcauucuauauaagagagaaacuacacgcagcgccucauuuugugggucaccauauucuugggaacaagagcuacagcaugggagguuggucuuccaaaccucgacaaggcauggggacaaaucuuucuguucccaauccucugggauucuuucccgaucaccaguuggacccugcguucggagccaacucaaacaauccagauugggacuucaaccccaacaaggaucacuggccagaggcaaaucagguaggagcgggagcauucgggccaggguucaccccaccacacggcggucuuuugggguggagcccucaggcucagggcacauugacaacagugccaguagcaccuccuccugccuccaccaaucggcagucaggaagacagccuacucccaucucuccaccucuaagagacagucauccucaggccaugcaguggaa

SEQ ID NO: 515 - RNA, 3215 nt, Hepatitis B virus
aacuccaccacuuuccaccaaacucuucaagaucccagagucagggcccuguacuuuccugcugguggcuccaguucaggaacagugagcccugcucugaauacugucucugccauaucgucaaucuuaucgaagacuggggacccuguaccgaacauggagaacaucgcaucaggacuccuaggaccccugcucguguuacaggcgggguuuuucuuguugacaaaaauccucacaauaccacagagucuagacucgugguggacuucucucaauuuucuagggggaacacccgugugucuuggccaaaauucgcagucccaaaucuccagucacucaccaaccuguuguccuccaauuuguccugguuaucgcuggaugugucugcggcguuuuaucaucuuccucugcauccugcugcuaugccucaucuucuuguugguucuucuggacuaucaagguauguugcccguuuguccucuaauuccaggaucaucaacaaccagcaccggaccaugcaaaaccugcacaacuccugcucaaggaaccucuauguuucccucauguugcuguacaaaaccuacggacggaaacugcaccuguauucccaucccaucaucuugggcuuucgcaaaauaccuaugggagugggccucaguccguuucucuuggcucaguuuacuagugccauuuguucagugguucguagggcuuucccccacugucuggcuuucaguuauauggaugaugugguuuugggggccaagucuguacaacaucuugagucccuuuaugccgcuguuaccaauuuucuuuugucuuuggguauacauuuaaacccucacaaaacaaaacgauggggauauucccuuaacuucaugggauauguaauugggaguuggggcacauugccacaggaacauauuguacaaaaaaucaaacuguguuuuaggaaacuuccuguaaacaggccuauugauuggaaaguaugucaacgaauugugggucuauugggguuugccgccccuuuuacacaauguggauauccugcucuaaugccuuuauaugcauguauacaagcaaaacaggcuuuuacuuucucgccaacuuacaaggccuuucuaaguaaacaguaucugaaccuuuaccccguugcucggcaacggccuggucugugccaaguguuugcugacgcaacccccacugguuggggcuuggcgauaggccaucagcgcaugcgugggaccuuucugucuccucugccgauccauacugcggaacuccuagcagcuuguuuugcucgcagcaggucuggggcaaaacucaucgggacugacaauucugucguacucucccgcaaguauacaucauuuccauggcugcuaggcugugcugccaacuggauccugcgcgggacguccuuuguuuacgucccgucggcgcugaaucccgcggacgaccccucgcggggccgcuuggggcucuaccgcccgcuucuccgccuguucuaccgaccgaccacggggcgcaccucucuuuacgcggacuccccgucugugccuucucaucugccggaccgugugcacuucgcuucaccucugcacgucgcauggagaccaccgugaacgcccacaggaaccugcccaaggucuugcauaagaggacucuuggacuuucagcaaugucaacgaccgaccuugaggcauacuucaaagacuguguguuuaaugagugggaggaguugggggaggagguuagguuaaaggucuuuguacuaggaggcuguaggcauaaauugguguguucaccagcaccaugcaacuuuuucaccucugccuaaucaucucauguucauguccuacuguucaagccuccaagcugugccuuggguggcuuuggggcauggacauugacccguauaaagaauuuggagcuucuguggaguuacucucuuuuuugccuucugacuucuuuccuucuauucgagaucuccucgacaccgccucugcucuguaucgggaggccuuagagucuccggaacauuguucaccucaccauacggcacucaggcaagcuauucuguguuggggugaguugaugaaucuagccaccugggugggaaguaauuuggaagauccaucauccagggaauuaguagucagcuaugucaacguuaauaugggcauaaaaaucagacaacuauugugguuucacauuuccugucucacuuuugggagagaaacuguucuugaauauuuggugucuuuuggaguguggauucgcacuccuccugcauauagaccaccaaaugccccuaucuuaucaacacuuccggaaacuacuguuguuagacgaagaggcagguccccuagaagaagaacucccucgccucgcagacgaaggucucaaucgccgcgucgcagaagaucucaaucucgggaaucucaauguuaguauuccuuggacacauaaggugggaaacuuuacggggcuuuauucuucuacuguaccuugcuuuaauccuaaagggcaaacuccuucuuuuccugauauucauuugcaggaggacauuguugauagauguaagcaauuuguggggccccuuacaguaaaugaaaacaggagacuaaaauuaauuaugccugcuagauuuuaucccaauguuacuaaauauuugcccuuagauaaagggaucaaaccguauuauccagaguauguaguugaucauuacuuccagacgcgacauuauuuacacacucuuuggaaggcggggauuuuauauaaaagagaguccacacguagcgccucauuuugcgggucaccauauucuugggaacaagaucuacagcaugggagguuggucuuccaaaccucgaaaaggcauggggacaaaucuuucuguccccaauccccugggauucuuccccgaucaucaguuggacccugcauucaaagccaacucagaaaauccagauugggaccucaacccgcacaaggacaacuggccggacgccaacaaggugggagugggagcauucgggccgggguucaccccuccccaugggggacuguugggguggagcccucaggcucagggccuacucacaacugugccaacagcgccuccuccugccuccaccaaucggcagucaggaaggcagccuacucccuuaucuccaccucuaagggacacucauccucaggccgugcagugg

SEQ ID NO: 516 - RNA, 3221 nt, Hepatitis B virus
auggcugcuagguuguacugccaacuggauucuucgagggacguccuuuguuuacgucccgucggcgcugaaucccgcggacgaccccucgcgaggccgcuuggggcuguaucguccccuucuccgucugccguaccguccgaccacggggcgcaccucucuuuacgcggucuccccgucugugccuucucaucugccgguccgugugcacuucgcuucaccucugcacguugcauggagaccaccgugaacgcccaucagguccugcccaaggucuuacauaagaggacucuuggacucucagcaaugucaacgaccgaccuugaggccuacuucaaagacuguguguuuaaagacugggaggaguugggggaggagauuagguuaaaggucuuuguauuaggaggcuguaggcauaaauuggucugcgcaccaucaucaugcaacuuuuucaccucugccuaaucaucucuuguacaugucccacuuuucaagccuccaagcugugccuuggauggcuuuggggcauggacauugacccuuauaaagaauuuggagcuacuguggaguuacucucauuuuugccuucugacuucuuuccuuccguccgggaucuacuagauacagccucagcucuauaucgggaagccuuagagucuccugagcauugcucaccucaccauacagcacucaggcaagccauucucugcuggggggaauuaaugacucuagcuaccuggguggguaauaauuuggaagauccagcauccagggaucuaguagucaauuauguuaauacuaacaugggccuaaagaucaggcaauuauugugguuucauauuucuugccuuacuuuuggaagagaaacuguccuugaguauuuggucucuuucggaguguggauucgcacuccaccagcuuauagaccaccaaaugccccuaucuuaucaacacuuccggaaacuacuguuguuagacgacgagaccgaggcagguccccuagaagaagaacucccucgccucgcagacgaagaucucaaucgccgcgucgcagaagaucucaaucucgggaaucucaauguuaguauuccuuggacucauaaggugggaaauuuuacugggcuuuacucuucuacugucccuaucuuuaauccugaauggcaaaccccuucuuuuccuaaaauucauuuacaugaagacauugcuaauaggugucagcaauuuguaggcccucucacuguaaaugaaaaaagaagacugaaauuaauuaugccugcuagguuuuaucccaacagcacaaaauauuugccuuuagacaaagggauuaaaccuuauuauccugaucauguaguuaaucauuacuuucaaacccgacauuauuuacauacucuuuggaaggcugggauucuauauaagagggaaacuacacguagcgccucauuuugcgggucaccauauucuugggaacaagagcuacaucaugggagguuggucaucaaaaccucgcaaaggcauggggacgaaccuuucuguucccaacccucugggauucuuucccgaucaucaguuggacccugcauucggagccaauucaaacaauccagauugggacuucaaccccaucaaggaccacuggccacaagccaaccagguaggagugggagcauucgggccaggguucacucccccacacggagguguuuugggguggagcccucaggcucagggcauauuggccacagugccagcagugccuccuccugccuccaccaaucggcagucaggaaggcagccuacucccaucucuccaccucuaagagacagucauccucaggccaugcaguggaauuccacagcuuuccaccaagcucugcaagaucccagagucaggggccuguauuuuccugcugguggcuccaguucaggaacacucaacccuguuccaacuauugccucucacaucucgucaaucuccucgaggauuggggacccugugccgaacauggagaacaucacaucaggauuccuaggaccccugcucguguuacaggcgggguuuuucuuguugacaagaauccucacaauaccgcagagucuagacucgugguggacuucucucaauuuucuagggggaucacccgugugucuuggccaaaauucgcaguccccaaccuccaaucacucaccaaccuccuguccuccaauuuguccugguuaucgcuggaugugucugcggcguuuuaucauauuccucuucauccugcugcuaugccucaucuucuuauugguucuucuggauuaucaagguauguugcccguuuguccucuaauuccaggaucaacaacaaccagcacgggacccugcaaaaccugcacgacuccugcucaaggcaacucuauguuucccucauguugcuguacaaaaccuacggauggaaauugcaccuguauucccaucccaucaucuugggcuuucgcaaaauaccuaugggagugggccucaguccguuucucuuggcucaguuuacuagugccauuuguucagugguucguagggcuuucccccacuguuuggcuuucagcuauauggaugaugugguacugggggccaagucuguacagcaucuugagucccuuuauaccgguguuaccaauuuucuuuugucuuuggguauacauuuaaacccuaacaaaacaaagagaugggguuauucacugaauuucauggguuauguaauuggaaguugggguacauugccacaggaucauauuguacaaaaaaucaaacacuguuuuagaaaacuuccugucaaucgaccuauugauuggaaaguaugucaaagaauugugggucuuuugggcuuugccgcuccauuuacacaaugugguuauccugcauuaaugccuuuguaugcauguauacaagcaaaacaggcuuuuacuuucucgccaacuuacaaggccuuucuaaguaaacaguauaugaaccuuuaccccguugcccggcaacggccuggucugugccaaguguuugcugacgcaacccccacuggcuggggcuuggccaucggccaucagcgcaugcgcggaaccuuuguggcuccucugccgauccauacugcggaacuccuggccgcuuguuuugcucgcagccggucuggagcaaaacucaucgggacugauaauucugucguccuuucucggaaauauacaucauuucc

SEQ ID NO: 517 - RNA, 3215 nt, Hepatitis B virus
cuccaccacguuccaccaaacucuucaagaucccagagucagggcucuguacuuuccugcugguggcuccaguucaggaacaguaaacccuguucagaacacugccucuuccauaucgucaaucuuaucgacgacuggggacccugugccgaacauggagaacaucgcaucaggacuccuaggaccccugcucguguuacaggcgggguuuuucucguugacaaaaauccucacaauaccacagagucuagacucgugguggacuucucucaauuuucuagggggaacacccgugugucuuggccaaaauucgcagucccaaaucuccagucacucaccaacuuguuguccuccgauuuguccugguuaucgcuggaugugucugcggcguuuuaucaucuuccucugcauccugcugcuaugccucaucuucuuguugguucuucuggacuaucaagguauguugcccguuuguccucuaauuccaggaucaucaaccaccagcacaggaccaugcaaaaccugcacgacuccugcucaaggaaccucuauguuucccucauguugcuguauaaaaccuacggacggaaacugcaccuguauucccaucccaucaucuugggcuuucgcaaaauaccuaugggagugggccucaguccguuucucuuggcucaguuuacuagugccauuuguucagugguucguagggcuuucccccacugucuggcuuucaguuauauggaugaugugguuuugggggccaagucuguacaacaucuugagucccuuuaugccgcuguuaccaauuuucuuuugucuuugggcauacauuuaaacccucagaaaacaaaaagauggggcuacucccuuaacuucaugggguauguaauuggaaguugggggaccuuaccccaagaacauauuguguugaaaaucaaacaauguuuuaggaaacuuccuguaaacaggccuauugauuggaaaguaugucaacgaauugugggucuuuugggauuugcugcuccuuucacacaauguggauauccugcuuuaaugccuuuauaugcauguauacaagcuaaacaggcuuuuacuuuuucgccaacguauaaggccuuucuccacaaacaauaucugaaccuuuaccccguugcucggcaacggccaggucugugccaaguguuugcugacgcaacccccacuggcuggggcuuggccauaggccaucagcgcaugcgugggaccuuugugucuccucugccgauccauacugcggaacuccuagccgcuuguuuugcucgcagcaggucuggagcaaaacuuaucgggacugacaauucugucguccuuucccgcaaauauacaucguuuccauggcugcuaggcugugcugccaacuggauccugcgcgggacguccuuugucuacgucccgucggcgcugaaucccgcggacgaccccucccggggccgcuuggggcucuaccgcccgcuucuccgccugccguaccguccgaccacggggcgcaccucucuuuacgcggacuccccgucugugccuucucaucugccggaccgugugcacuucgcuucaccucugcacgucgcauggagaccaccgugaacgcccaucggaaccugcccaaggucuugcauaagaggacucuuggacuuucagcaaugucaacgaccgaccuugaggcauacuucaaagacuguguguuuacugagugggaggaguugggggaggagaucagguuaaaggucuuuguacuaggaggcuguaggcauaaauuggucuguucaccagcaccaugcaacuuuuucaccucugccuaaucaucucauguucauguccuacuguucaagccuccaagcugugccuuggguggcuuuggggcauggacauugacaccuauaaagaauuuggagcuucuguggaguuacucucuuuuuugccuucugacuucuuuccuucuauucgagaucuucucgacaccgccucugcucuguaucgggaggccuuagagucuccggaacauuguucaccucaccauacggcacucaggcaagcuauuguguguuggggugaguugaugaaucuagccaccugggugggaaguaauuuggaagacccagccucccgggaauuaguagucaguuaugucaauguuaauaugggccuaaaaaucagacaacuauugugguuucacauuuccugucuuacuuuuggaagagaaacuguucuugaauauuuggugucuuuuggaguguggauucgcacaccuccagcauauagaccaccaaaugccccuaucuuaucaacacuuccggaaacuacuguuguuagacgacgaggcagguccccuagaagaagaacucccucgccucgcagacgaaggucucaaucgccgcgucgcagaagaucucaaucucgggaaucuaaauguuaguauuccuuggacucauaaggugggaaacuuuacggggcuuuauucuucuacgguaccuagcuuuaauccucaauggcaaacuccuucauuuccugacauucauuugcaggaggacaucauugauaaguguaaacaauuugugggaccccuuacagugaaugaaaacaggagacuaaaauugauuaugccugcuagguucuaucccaauguuacuaaauauuugcccuuagauaaaggaauuaaaccuuauuauccagagcauguaguuaaucauuacuuccagacgagacauuauuuacauacucuuuggaaggcggguaucuuauauaaaagagagacaacacguagcgccucauuuugcgggucaccauauucuugggaacaagagcuacagcaugggagguugguccuccaaaccucgaaaaggcauggggacaaaucuuuccguccccaauccucugggauucuuucccgaucaccaguuggacccugcauucaaagccaacuccgacaaucccgauugggaccucaacccacacaaggacaacuggccggacuccaacaaggugggagugggagcauucgggccgggauucacuccaccccaugggggacuguugggguggagcccucaagcucagggcauacucacaacugugccaacagcuccuccuccugccuccaccaaucggcaguuaggaaggaagccuacuccccugucuccaccucuaagagacacucauccucaggcaaugcaguggaa

SEQ ID NO: 518 - RNA, 3212 nt, Hepatitis B virus
uuccacaacauuucaccaagcucugcaggaucccagaguaagaggccuguauuuuccugcugguggcuccaguuccggaacagugaacccuguuccgacuacugccucacucaucucgucaaucuucucgaggauuggggacccugcaccgaacauggaaagcaucacaucaggauuccuaggaccccugcucguauuacaggcgggguuuuucuuguugacaaaaauccucacaauaccgcagagucuagacucgugguggacuucucucaauuuucuagggggagcucccgugugucuuggccaaaauucgcaguccccaaccuccaaucacucaccaaccucuuguccuccaauuuguccuggcuaucgcuggaugugucugcggcguuuuaucaucuuccucuucauccugcugcuaugccucaucuucuuguugguucuucuggacuaucaagguauguugcccguuuguccucuaauuccaggaucaucaaccaccaguacgggacccugccgaaccugcacgacucuugcucaaggaaccucuauguuucccucauguugcuguucaaaaccuucggacggaaauugcacuuguauucccaucccaucaucaugggcuuucggaaaauuccuaugggagugggccucagcccguuucuccuggcucaguuuacuagugccauuuguucagugguucgccgggcuuucccccacugucuggcuuucaguuauauggaugaugugguauugggggccaagucuguacaacaucuugagucccuuuauaccucuguuaccaauuuucuuuugucuuuggguauacauuuaaaucccaacaaaacaaaaagauggggauauucccugaauuucauggguuauguaauuggaaguuggggaucauuaccacaggaacacaucauaaugaaaaucaaagacuguuuuagaaaacuccccguuaaccggccuauugauuggaaaguaugucaacgaauugugggucuuuugggcuuugcugccccuuuuacacaauguggguauccugcuuuaaugccucuguaugcguguauucaaucuaagcaggcuuucacuuucucgccaacuuacaaggccuuucuguguaaacaauaccugaaccuuuaccccguugcccggcaacggccaggucugugccaaguguuugcugaugcaacccccacuggcuggggcuuggccauaggccaucagcgcaugcgcggaaccuuuauggcuccucugccgauccauacugcggaacuccuagccgcuuguuuugcucgcagcaggucuggagcgaaacuuaucgggacagauaauucugucguucucucccggaaauauacauccuuuccauggcugcuaggcugugcugccaacuggauccugcgagggacguccuuugucuacgucccgucagcgcugaauccugcggacgacccgucucggggucgcuuggggaucuaucguccccuucuccgucugccguuccagccguccacggggcgcaccucucuuuacgcggucuccccgucugugccuucucaucugccggaccgugugcacuucgcuucaccucugcacgucgcauggagaccaccgugaacgcccaccaaaucuugcccaaggucuuacauaagaggacucuuggacucucugcaaugucaacgaccgaccuugaggcauacuucaaagacuguuuguuuaaagacugggaggaguugggggaggagauuagauuaaaggucuuuguacuaggaggcuguaggcauaaauuggucugcgcaccagcaccaugcaacuuuuucaccucugccuaaucaucucuuguucauguccuacuguucaagccuccaagcugugccuuggguggcuuuggggcauggacauugacccuuauaaagaauuuggagcuacuguggaguuacucucguuuuugccuucugacuucuuuccuucaguaagagaucuucuagauaccgccucagcuuuguaucgggaugccuuagaaucuccugagcauuguucaccgcaucacacugcacucaggcaagccauucuuugcuggggggaacuaaugacucuagcuaccuggguggguguaaauuuggaagauccagcauccagggaccuaguagucaguuaugucaauacuaauaugggccuaaaguucaggcaauuauugugguuucacauuucuugucucacuuuuggaagagaaaccgucauagaguauuuggugucuuuuggaguguggauucgcacuccuccagcuuauagaccaccaaaugccccuaucuuaucaacacuuccggagaauacuguuguuagacgaagaggcagguccccuagaagaagaacucccucgccucgcagacgaagaucucaaucgccgcgucgcagaagaucucaaucuccagcuucccaauguuaguauuccuuggacucacaaggugggaaauuuuacggggcuuuacucuucuacuauaccugucuuuaauccuaacuggaaaacuccaucuuuuccugauauucauuugcaccaggacauuauuaacaaaugugaacaauuuguagguccucuaacaguaaaugaaaaacgaagauuaaacuuagucaugccugcuagauuuuuucccaucucuacgaaauauuugccccuagagaaagguauaaaaccuuauuauccagauaauguaguuaaucauuacuuccaaaccagacacuauuuacacacccuauggaaggcgggcaucuuauauaaaagagaaacuacacguagcgccucauuuugugggucaccuuauucuugggaacaagagcuacaucauggggcuuucuuggacggucccucucgaaugggggaagaaucauuccaccaccaauccucugggauuuuuucccgaccaccaguuggauccagcauucagagcaaacaccagaaauccagauugggaccacaaucccaacaaagaccacuggacggaagccaacaagguaggagugggagcauucgggccgggguucacucccccacacggaggccuuuugggguggagcccucaggcucaaggcaugcuaaaaacauugccagcagauccgccuccugccuccaccaaucggcagucaggaaggcagccuaccccaaucacuccaccuuugagagacacucauccucaggccaugcaguggaa

SEQ ID NO: 519 - RNA, 3248 nt, Hepatitis B virus
cucuacagcauuccaccaagcucuacaaaaucccaaagucaggggccuguauuuuccugcugguggcuccaguucagggauagugaacccuguuccgacuauugccucucacaucucgucaaucuucuccaggauuggggacccugcaccgaacauggagaacaucacaucaggauuccuaggaccccugcucguguuacaggcgggguuuuucuuguugacaagaauccucacaauaccgcagagucuagacucgugguggacuucucucaauuuucuagggggagugcccguguguccuggccuaaauucgcaguccccaaccuccaaucacucaccaaucuccuguccuccaacuuguccuggcuaucgcuggaugugucugcggcguuuuaucauauuccucuucauccugcugcuaugccucaucuucuuguugguucuucuggacuaucaagguauguugcccguuuguccucugauuccaggauccucgaccaccaguacgggacccugcaaaaccugcacgacuccugcucaaggcaacucuauguaucccucauguugcuguacaaaaccuucggacggaaauugcaccuguauucccaucccaucaucuugggcuuucgcaaaauaccuaugggagugggccucaguccguuucucuuggcucaguuuacuagugccauuuguucagugguucguagggcuuucccccacugucuggcuuucagcuauauggaugaugugguauugggggccaaaucuguacaacaucuugagucccuuuauaccgcuguuaccaauuuucuuuugucuuuggguauacaucuaaacccuaacaaaacaaaaagaugggguuauuccuuaaauuuuaugggauauguaauuggaaguugggguacuuugccacaagaacacaucacacagaaaauuaagcaauguuuucggaaacucccuguuaacaggccaauugauuggaaagucugucaacgaauaacuggucuguuggguuucgcugcuccuuucacccaaugugguuacccugccuuaaugccuuuauaugcauguauacaagcuaagcaggcuuuuacuuucucgccaacuuauaaggccuuucucuguaaacaauacaugaaccuuuaccccguugcuaggcaacggcccggucugugccaaguguuugcugacgcaacccccacugguuggggcuuggccaucggccaucagcgcaugcguggaaccuuuguggcuccucugccgauccauacugcggaacuccuagcugcuuguuuugcucgcagccggucuggagcaaaacucauugggacugacaauucugucguccuuucucggaaauauacauccuuuccauggcugcuaggcugugcugccaacuggauccuucgcgggacguccuuuguuuacgucccgucagcgcugaauccagcggacgaccccucccggggccguuuggggcucugucgcccccuucuccgucugccguuccugccgaccacggggcgcaccucucuuuacgcggucuccccgucuguuccuucucaucugccggaccgugugcacuucgcuucaccucugcacguuacauggaaaccgccaugaacaccucucaucaucugccaaggcaguuauauaaguggacucuuggacuguuuguuaugucaacaaccgggguggagaaauacuucaaggacuguguuuuugcugagugggaagaauuaggcaaugaguccagguuaaugaccuuuguauuaggaggcuguaggcauaaauuggucugcgcaccagcaccauguaacuuuuucaccucugccuaaucaucucuuguucauguccuacuguucaagccuccaagcugugccuuggguggcuuuagggcauggauagaacaacuuugccauauggccuuuuuggcuuagacauugacccuuauaaagaauuuggagcuacuguggaguugcucucguuuuugccuucugacuuuuucccgucuguucgugaucuucucgacaccgcuucagcuuuguaccgggaauccuuagaguccucugaucauuguucgccucaccauacagcacucaggcaagcaauccugugcuggggugaguugaugacucuagcuaccuggguggguaauaauuuggaagauccagcauccagagauuugguggucaauuauguuaauacuaauauggguuuaaaaaucaggcaacuauugugguuucacauuuccugucuuacuuuugggagagaaaccguucuugaguauuuggugucuuuuggaguguggauucgcacuccuccugcuuauagaccaccaaaugccccuauccuaucaacacuuccggagacuacuguuguuagacgaagaggcagguccccucgaagaagaacucccucgccucgcagacgaagaucucaaucgccgcgucgcagaagaucugcaucuccagcuucccaauguuaguauuccuuggacucacaaggugggaaacuuuacggggcuguauucuucuacuauaccugucuuuaauccugauuggcaaacuccuucuuuuccaaauauccauuugcaucaagacauuauaacuaaaugugaacaauuugugggcccucucacaguaaaugagaaacgaagauuaaaacuaguuaugccugccagauuuuucccaaacucuacuaaauauuuaccauuagacaaagguaucaaaccguauuauccagaaaauguaguuaaucauuacuuccagaccagacauuauuuacauacccuuuggaaggcggguauucuauauaagagagaaacaucccguagcgcuucauuuugugggucaccauauacuugggaacaagaucuacagcauggggcuuucuuggacggucccucucgaguggggaaagaaccuuuccgccagcaauccucuaggauuccuucccgaucaccaguuggacccagcauucagagcaaauaccaacaauccagauugggacuucaaucccaaaaaggacccuuggccagaggccaacaagguaggaguuggagccuauggacccggguucaccccuccacacggaggccuuuugggguggagcccucagucucagggcacacuaacaacuuugccagcagauccgccuccugccuccaccaaucgucagucagggaggcagccuacucccaucucuccaccacuaagagacagucauccucaggccaugcaguggaa

SEQ ID NO: 520 - RNA, 3215 nt, Hepatitis B virus
cucaacucaguuccaccaggcucuguuggauccgaggguaagggcucuguauuuuccugcugguggcuccaguucagggacacagaacccugcuccgacuauugccucucucacaucaucaaccuucucgaagacugggggcccugccaugaacauggagaacaucacaucaggacuccuaggaccccugcucguguuacaggcgguguguuucuuguugacaaaaauccucacaauaccacagagucuagacucgugguggacuucucucaauuuucuagggggacuacccggguguccuggccaaaauucgcaguccccaaccuccaaucacuuaccaaccuccuguccuccaacuuguccuggcuaucguuggaugugucugcggcguuuuaucaucuuccucuucauccugcugcuaugccucaucuucuuguugguucuucuggacuaccaagguauguugcccguuuguccucuacuuccaggauccacgaccaccagcacgggaccaugcaaaaccugcacaacucuugcucaaggaaccucuauguuucccuccuguugcuguuccaaacccucggacggaaacugcaccuguauucccaucccaucaucuugggcuuuaggaaaauaccuaugggagugggccucagcccguuucuccuggcucaguuuacuagugcaauuuguucaguggugcguagggcuuucccccacugucuggcuuuuaguuauauggaugaucugguauugggggccaaaucugugcagcaucuugagucccuuuauaccgcuguuaccaauuuucuguuaucuguggguauccauuuaaauacugcuaaaacaaaaagaugggguuacacccuacauuucauggguuauguuauugguaguuggggaacguuaccccaagaccauauuauacacaaaaucaaagauuguuuucggaaacuuccuguaaaucguccaauugauuggaaaguuugucaacgcauugugggucuuuugggcuuugcggccccuuucacccaaugugguuauccugcucucaugccuuuguauaccuguauuacugcuaaacaggcuuuugucuuuucgccaacuuacaaggccuuucucuguaaacaauacaugaaccuuuaccccguugcucggcaacggccaggccugugccaaguguuugcugacgcaacccccacugguuggggcuuggccauuggccaucagcgcaugcguggaaccuuuguggcuccucugccgauccauacugcggaacuccuugcagccuguuucgcucgcagccggucuggagcgaacauuaucgguacagacaacucuguuguccucucuaggaaguacaccuccuuuccauggcugcucgguugugcugccaacuggauccugcgcgggacguccuuuguuuacgucccgucggcgcugaaucccgcggacgaccccucccggggucgcuuggggcuguaccgcccccuucuucgucugccguuccagccgaccacgggucgcaccucucuuuacgcggacuccccgucuguuccuucucaucugccggaccgugugcacuucgcuucaccucugcacgucgcauggagaccaccgugaacgcccccuggaaucugccaacagucuuacauaagaggacucuuggacuuucaggacggucaaugaccuggaucgaagacuacaucaaagacuguguauuuaaggacugggaggagcugggggaggagaucagguuaaaggucuuuguacuaggaggcuguaggcauaaauuggucuguucaccagcaccaugcaacuuuuucaccucugccuaaucaucuuuuguucaugucccacuguucaagccuccaagcugugccuuggguggcuuuggggcauggacauugacccuuauaaagaauuuggagcuucuguggaauugcucucuuuuuugccuucugauuucuucccgucuguucgggaccuacucgacaccgcuucagcccuguaccgggaugcucuagagucaccggaacauugcacccccaaucauaccgcucucaggcaagcuauuuugugcuggggugaguuaaugacuuuggcuuccuggguggguaauaauuuggaagacccugcagcuagggauuuaguaguuaauuaugucaacacuaauaugggccugaaaauuagacaacuguugugguuucacauuuccugucuuacuuuuggaagagaaacaguucuugaguauuuggucuccuuuggaguguggauucgcacuccaccugcuuauagaccaccaaaugccccuauccuauccacacuuccggaaacuacuguuguuagacgacgaggcagguccccuagaagaagaacucccucgccucgccgacgaaggucucaaucgccgcgucgcagaagaucucaaucuccagcuucccaauguuaguauuccuuggacucauaaggugggaaauuuuacggggcucuacucuucuacuguaccugcuuucaauccuaacugguuaacuccuucuuuuccugauauucauuuacaccaggaucugauaucuaaaugugaacaauuuguaggcccgcucacuaaaaaugaauugagaagauuaaaauuggucaugccagcuagauuuuauccuaagguuaccaaauacuuuccuauggagaaagggauuaaacccuauuauccugagcaugcaguuaaucauuauuuuaaaacaagacauuauuugcauacuuuauggaaggcgggaaucuuauauaagagagaauccacacguagcgccucauuuugugggucaccauauuccugggaacaagagcuacagcaugggagcaccucucucaacgacaagaaggggcaugggacugaaucuuucugugcccaauccucugggcuucuugccagaccaucagcuggauccgcuauucagagcaaauuccagcagucccgacugggacuucaacacaaacaaggacaguuggccaauggcaaacaagguaggagugggaggcuacgguccaggguucacacccccucacgguggccugcugggguggagcccucaggcacaggguguuuuaacaaccuugccagcagauccgccuccugcuuccaccaaucggcgguccgggagaaagccaaccccagucucuccaccucuaagagacacacauccacaggccaugcaguggaa

SEQ ID NO: 521 - RNA, 3215 nt, Hepatitis B virus
cucaacccaguuccaccaggccuuguuggauccgaggguaagggcucuguauuuuccugcugguggcuccaguucagagacgcagaacccugcuccgacuauugccucucucacaucaucaaucuucucgaagacugggggcccugcuaugaacauggacagcaucacaucaggacuccuaggaccccugcucguguuacaggcgguguguuucuuguugacaaaaauccucacaauaccacagagucuagacucgugguggacuucucucaauuuucuagggggacuacccggguguccuggccaaaauucgcaguccccaaccuccaaucacuuaccaaccuccuguccuccaacuuguccuggcuaucguuggaugugucugcggcguuuuaucaucuuccucuucauccugcugcuaugccucaucuucuuguugguucuucuggacuaucaagguauguugcccguuuguccucuaauuccaggaucuacgaccaccagcacgggaccaugcaaaaccugcacaacucuugcucaaggaaccucuauguuucccuccuguugcuguuccaaacccucggacggaaacugcaccuguauucccaucccaucaucuugggcuuuaggaaaauaccuaugggagugggccucagcccguuucuccuggcucaguuuacuagugcaauuuguucaguggugcguagggcuuucccccacugucuggcuuuuaguuauauggaugaucugguauugggggccaaaucugugcagcaucuugagucccuuuauaccgcuguuaccaauuuucuguuaucuguggguauccauuugaauaccucuaaaacaaaaagaugggguuacaauuuacauuucauggguuauguaauuggcaguuggggagcauuaccccaagaucauauuguacacaaaaucaaagaauguuuuagaaaacuuccuguaaaucguccaauugacuggaaaguuugucaacguauugugggacuuuugggcuuugcugcuccuuuuacccaaugugguuauccugcucucaugccucuguauaccuguaucacugcgaaacaggcuuuugucuuuucgccaacuuacaaggccuuucucuguaaacaguacaugaaccuuuaccccguugcucggcaacggccaggccugugccaaguguuugcugacgcaacccccacugguuggggcuuggccauuggccaucagcgcaugcguggaaccuuuguggcuccucugccgauccauacugcggaacuccuugcagcuuguuucgcucgcagccggucuggagcgaauaucaucgggacagacaacucuguuguacucucuaggaaguacaccuccuucccauggcugcucggaugugcugccaacuggauccugcgcgggacguccuuuguuuacgucccgucggcgcugaaucccgcggacgaccccucccggggccgcuuggggcucuaccgcccucuucugcgucugccguuccagccgaccacgggucgcaccucucuuuacgcggacuccccgucuguuccuucucaucugccgguccgugugcacuucgcuucaccucugcacgucgcauggagaccaccgugaacgcccccuggaguuugccaacagucuuacauaaaaggacuauuggacuuucaggacggucaaugaccuggaucgaagaauacaucaaagacuguguauuuaaagacugggaggaguugggggaggagaucagguuaaaggucuuuguacuaggaggcuguaggcauaaauuggucuguucaccagcaccaugcaacuuuuucaccucugccuaaucaucuuuuguucauguccuacuguucaagccuccaagcugugccuuggguggcuuuggggcauggacauugacccuuauaaagaauuuggagcuucuguggaauugcucucuuuuuugccuucugauuucuucccgucgguucgggaccuacucgacaccgcuucagcucucuacagggaugcuuuagagucaccggaacauugcacccccaaucauaccgcucucaggcaagcuauuuuguguuggggugaauuaaugacuuuggcuuccugggugggcaauaauuuggaggacccugcagccagggauuuaguaguuaacuauguuaacacuaacaugggcuuaaagauuagacaauuauugugguuucacauuuccugccuuacuuuuggaagagaaacaguucuugaguauuugguguccuuuggaguguggauucgcacuccuccagcuuauagaccaccaaaugccccuauccuauccacacuuccggaaacuacuguuguuagacgacgaggcagguccccuagaagaagaacucccucgccucgcagacgaaggucucaaucgccgcgucgcagaagaucucaaucuccagcuucccaauguuaguauuccuuggacucauaaggugggaaauuuuacggggcucuacucuucuacuguaccugcuuucaauccucacugguuaacuccuucuuuuccugauauucauuugcaucaagaccugauaucuaaaugugaacaauuuguaggcccacuuaccaaaaaugaauugagaagguugaaauugauuaugccagccagauucuuuccuaaacuuacuaaauauuuuccucuggagaaaggcauuaaaccuuauuauccugagcaugcaguuaaucauuauuuuaagaccagacauuauuugcauacuuuauggaaggcgggaauuuuauauaagagagaauccacacguagcgccucauuuugugggucaccauauuccugggaacaagagcuacagcaugggagcaccucucucaacgacaagaaggggcaugggacagaaucucucugugcccaauccacugggauucuuuccagaacaucagcuggauccucuuuucagagcaaauuccagcagucccgauugggacuucaacaaaaacaaggacacuuggccaauggcaaacaagguaggagugggagguuacgguccaggguucacacccccacacgguggccuguugggguggagcccucaggcacaagguguucuaacaaccuugccagcagauccgccuccugcuuccaccaaucggcgguccgggaggaagccaaccccagucucuccaccucuaagagacacacauccacaggcaaugcaguggaa

SEQ ID NO: 522 - RNA, 3248 nt, Hepatitis B virus
cucuacagcauuccaccaagcucuacaaaaucccaaagucaggggccuguauuuuccugcugguggcuccaguucagggauagugaacccuguuccgacuauugccucucacaucucgucaaucuucuccaggauuggggacccugcaccgaauauggagaacaucacaucaggauuccuaggaccccugcucguguuacaggcgggguuuuucuuguugacaagaauccucacaauaccgcagagucuagacucgugguggacuucucucaauuuucuagggggagugcccguguguccuggccuaaauucgcaguccccaaccuccaaucacucaccaaucuccuguccuccaacuuguccuggcuaucgcuggaugugucugcggcguuuuaucauauuccucuucauccugcugcuaugccucaucuucuuguugguucuucuggacuaucaagguauguugcccguuuguccucugauuccaggauccucgaccaccaguacgggacccugcaaaaccugcacgacuccugcucaaggcaacucuauguaucccucauguugcuguacaaaaccuucggacggaaauugcaccuguauucccaucccaucaucuugggcuuucgcaaaauaccuaugggagugggccucaguccguuucucuuggcucaguuuacuagugccauuuguucagugguucguagggcuuucccccacugucuggcuuucagcuauauggaugaugugguauugggggccaaaucuguacaacaucuugagucccuuuauaccgcuguuaccaauuuucuuuugucuuuggguauacaucuaaacccuaacaaaacaaaaagaugggguuauuccuuaaauuuuaugggauauguaauuggaaguugggguacuuugccacaagaacacaucacacagaaaauuaagcaauguuuucggaaacucccuguuaacaggccaauugauuggaaagucugucaacgaauaacuggucuguuggguuucgcugcuccuuuuacccaaugugguuacccugccuuaaugccuuuauaugcauguauacaagcuaagcaggcuuuuacuuucucgccaacuuauaaggccuuucucuguaaacaauacaugaaccuuuaccccguugcuaggcaacggcccggucugugccaaguguuugcugacgcaacccccacugguuggggcuuggccaucggccaucagcgcaugcguggaaccuuuguggcuccucugccgauccauacugcggaacuccuagcugcuuguuuugcucgcagccggucuggagcaaaacucauugggacugacaauucugucguccuuucucggaaauauacauccuuuccauggcugcuaggcugugcugccaacuggauccuucgcgggacguccuuuguuuacgucccgucagcgcugaauccagcggacgaccccucccggggccguuuggggcucugucgcccccuucuccgucugccguuccugccgaccacggggcgcaccucucuuuacgcggucuccccgucuguuccuucucaucugccggaccgugugcacuucgcuucaccucugcacguuacauggaaaccgccaugaacaccucucaucaucugccaaggcaguuauauaagaggacucuuggacuguuuguuaugucaacaaccgggguggagaaauacuucaaggacuguguuuuugcugagugggaagaauuaggcaaugaguccagguuaaugaccuuuguauuaggaggcuguaggcauaaauuggucugcgcaccagcaccauguaacuuuuucaccucugccuaaucaucucuuguucauguccuacuguucaagccuccaagcugugccuuggguggcuuuagggcauggauagaacaacuuugccauauggccuuuuuggcuuagacauugacccuuauaaagaauuuggagcuacuguggaguugcucucguuuuugccuucugacuuuuucccgucuguucgugaucuucucgacaccgcuucagcuuuguaccgggaauccuuagaguccucugaucauuguucgccucaccauacagcacucaggcaagcaauccugugcuggggugaguugaugacucuagccaccuggguggguaauaauuuggaagauccagcauccagagauuugguggucaauuauguuaauacuaauauggguuuaaaaaucaggcaacuauugugguuucacauuuccugucuuacuuuugggagagaaaccguucuugaguauuuggugucuuuuggaguguggauucgcacuccuccugcuuauagaccaccaaaugccccuauccuaucaacacuuccggagacuacuguuguuagacgaagaggcagguccccucgaagaagaacucccucgccucgcagacgaagaucucaaucgccgcgucgcagaagaucugcaucuccagcuucccaauguuaguauuccuuggacucacaaggugggaaacuuuacggggcuguauucuucuacuauaccugucuuuaauccggauuggcaaacuccuucuuuuccaaauauccauuugcaucaagacauuauaacuaaaugugaacaauuugugggcccucucacaguaaaugagaaacgaagauuaaaacuaguuaugccugccagauuuuucccaaacucuacuaaauauuuaccauuagacaaagguaucaaaccguauuauccagaaaauguaguuaaucauuacuuccagaccagacauuauuuacauacccuuuggaaggcggguauucuauauaagagagaaacaucccguagcgcuucauuuugugggucaccauauacuugggaacaagaucuacagcauggggcuuucuuggacggucccucucgaguggggaaagaaccuuuccaccagcaauccucuaggauuccuucccgaucaccaguuggacccagcauucagagcaaauaccaacaauccagauugggacuucaaucccaaaaaggacccuuggccagaggccaacaagguaggaguuggagccuauggacccggguucaccccuccacacggaggccuuuugggguggagcccucagucucagggcacacuaacaacuuugccagcagauccgccuccugccuccaccaaucgucagucagggaggcagccuacucccaucucuccaccacuaagagacagucauccucaggcccugcaguggaa

SEQ ID NO: 523 - RNA, 3248 nt, Hepatitis B virus
cucuacagcauuccaccaagcucuacaaaaucccaaagucaggggccuguauuuuccugcugguggcuccaguucagggauagugaacccuguuccgacuauugccucucacaucucgucaaucuucuccaggauuggggacccugcaccgaacauggagaacaucacaucaggauuccuaggaccccugcucguguuacaggcgggguuuuucuuguugacaagaauccucacaauaccacagagucuagacucgugguggacuucucucaauuuucuagggggagugcccguguguccuggccuaaauucgcaguccccaaccuccaaucacucaccaaucuccuguccuccaacuuguccuggcuaucgcuggaugugucugcggcguuuuaucauauuccucuucauccugcugcuaugccucaucuucuuguugguucuucuggacuaucaagguauguugcccguuuguccucugauuccaggauccucgaccaccaguacgggacccugcaaaaccugcacgacuccugcucaaggcaacucuauguaucccucauguugcuguacaaaaccuucggacggaaauugcaccuguauucccaucccaucaucuugggcuuucgcaaaauaccuaugggagugggccucaguccguuucucuuggcucaguuuacuagugccauuuguucagugguucguagggcuuucccccacugucuggcuuucagcuauauggaugaugugguauugggggccaaaucuguacaacaucuugagucccuuuauaccgcuguuaccaauuuucuuuugucuuuggguauacaucuaaacccuaccaaaacaaaaagaugggguuauuccuuaaauuuuaugggauauguaauuggaaguugggguacuuugccacaagaacacaucacacagaaaauuaagcaauguuuucggaaacucccuguuaacaggccaauugauuggaaagucugucaacgaauaacuggucuguuggguuucgcugcuccuuuuacccaaugugguuacccugccuuaaugccuuuauaugcauguauacaagcuaagcaggcuuuuacuuucucgccaacuuauaaggccuuucucuguaaacaauacaugaaccuuuaccccguugcuaggcaacggcccggucugugccaaguguuugcugacgcaacccccacugguuggggcuuggccaucggccaucagcgcaugcguggaaccuuuguggcuccucugccgauccauacugcggaacuccuagcugcuuguuuugcucgcagccggucuggagcaaaacucauugggacugacaauucugucguccuuucucggaaauauacauccuuuccauggcugcuaggcugugcugccaacuggauccuucgcgggacguccuuuguuuacgucccgucagcgcugaauccagcggacgaccccucccggggccguuuggggcucugucgcccccuucuccgucugccguuccugccgaccacggggcgcaccucucuuuacgcggucuccccgucugugccuucucaucugccggaccgugugcacuucgcuucaccucugcacguuacauggaaaccgccaugaacaccucucaucaucugccaaggcaguuauauaagaggacucuuggacuguuuguuaugucaacaaccgggguggagaaauacuucaaggacuguguuuuugcugagugggaagaauuaggcaaugaguccagguuaaugaccuuuguauuaggaggcuguaggcauaaauuggucugcgcaccagcaccauguaacuuuuucaccucugccuaaucaucucuuguucauguccuacuguucaagccuccaagcugugccuuggguggcuuuagggcauggauagaacaacuuugccauauggccuuuuuggcuuagacauugacccuuauaaagaauuuggagcuacuguggaguugcucucguuuuugccuucugacuuuuucccgucuguucgugaucuucucgacaccgcuucagcuuuguaccgggaauccuuagaguccucugaucauuguucgccucaccauacagcacucaggcaagcaauccugugcuggggugaguugaugacucuagcuaccuggguggguaauaauuuggaagauccagcauccagagauuugguggucaauuauguuaauacuaauauggguuuaaaaaucaggcaacuauugugguuucacauuuccugucuuacuuuugggagagaaaccguucuugaguauuuggugucuuuuggaguguggauucgcacuccuccugcuuauagaccaccaaaugccccuauccuaucaacacuuccggagacuacuguuguuagacgaagaggcagguccccucgaagaagaacucccucgccucgcagacgaagaucucaaucgccgcgucgcagaagaucugcaucuccagcuucccaauguuaguauuccuuggacucacaaggugggaaacuuuacggggcuguauucuucuacuauaccugucuuuaauccugauuggcaaacuccuucuuuuccaaauauccauuugcaucaagacauuauaacuaaaugugaacaauuugugggcccucucacaguaaaugagaaacgaagauuaaaacuaguuaugccugccagauuuuucccaaacucuacuaaauauuuaccauuagacaaagguaucaaaccguauuauccagaaaauguaguuaaucauuacuuccagaccagacauuauuuacauacccuuuggaaggcggguauucuauauaagagagaaacaucccguagcgcuucauuuugugggucaccauauacuugggaacaagaucuacagcauggggcuuucuuggacggucccucucgaguggggaaagaaccuuuccaccagcaauccucuaggauuccuucccgaucaccaguuggacccagcauucagagcaaauaccaacaauccagauugggacuucaaucccaaaaaggacccuuggccagaggccaacaagguaggaguuggagccuauggacccggguucaccccuccacacggaggccuuuugggguggagcccucagucucagggcacacuaacaacuuugccagcagauccgccuccugccuccaccaaucgucagucagggaggcagccuacucccaucucuccaccacuaagagacagucauccucaggccaugcaguggaa

SEQ ID NO: 524 - RNA, 3215 nt, Hepatitis B virus
gaacucaacacaguuccaccaagcacuguuggauccgagagucaggggucuguauuuuccugcugguggcuccaguucagaaacacagaacccuguuccgacuauugccucucucacaucaucaaucuucucgaagacuggggacccugcuaugaacauggagaacaucacaucaggacuccuaggaccccuucucguguuacaggcgguguguuucuuguugacaaaaauccucacaauaccacagagucuagacucgugguggacuucucucaauuuucuagggguaccacccggguguccuggccaaaauucgcaguccccaaucuccaaucacuuaccaaccuccuguccuccaacuuguccuggcuaucguuggaugugucugcggcguuuuaucaucuuccucuucauccugcugcuaugccucaucuucuuguugguucuucuggacuaucaagguauguugcccguguguccucuacuuccaggaucuacaaccaccagcacgggacccugcaaaaccugcaccacucuugcucaaggaaccucuauguuucccuccugcugcuguaccaaaccuucggacggaaauugcaccuguauucccaucccaucaucuugggcuuucggaaaauaccuaugggagugggccucagcccguuucucuuggcucaguuuacuagugcaauuuguucaguggugcguagggcuuucccccacugucuggcuuuuaguuauauggaugauuugguauugggggccaaaucugugcagcaucuugagucccuuuauaccgcuguuaccaauuuuuuguuaucugugggcauccauuuaaacacagcuaaaacaaaauggugggguuauuccuuacacuuuauggguuauaucauugggaguugggggacauugccucaggaacauauugugcaaaaaaucaaaaauugcuuucgcaaacuucccguuaaucgacccauugauuggaaagucugucaacgaauugugggucuuuugggcuuugcagccccuuuuacucaaugugguuauccugcucucaugcccuuauaugccuguauuaccgcuaaacaggcuuuuguuuucucgccaacuuacaaggccuuucucuguaaacaauacaugaaccuuuaccccguugcucggcaacggccaggccuuugccaaguguuugcugacgcaacccccacuggcuggggcuuggcgauuggccaucagcgcaugcgcggaaccuuuguggcuccucugccgauccauacugcggaacuccuagcagcuuguuucgcucgcagccggucuggagcggacauuaucggcacugacaacuccguuguccugucucggaaguacaccuccuucccauggcugcuaggcugugcugccaacuggauccugcgcgggacguccuuuguuuacgucccgucggcgcugaauccugcggacgaccccucucguggucgccuggggcucugccgcccccuucuccgccuuccguuccggccgacgacagggcgcaccucucuuuacgcggacuccccgccugugccuuuucaucagccggcccgugugcacuucgguucaccucugcacgucgcauggagaccaccgugaacgccccucaaagcuugccaacacccuuacauaaaaggacucuuggacuuucgccccggucaacgaccuggauugaggaauacaucaaagacuguguguuuaaggacugggaggagucgggggaggaguugagguuaaaggucuuuguauuaggaggcuguaggcauaaauuggucuguucaccagcaccaugcaacuuuuucaccucugccuaaucaucuuuuguucaugucccacuguucaagccuccaagcugugccuuggguggcuuuggggcauggacauugacccuuauaaagaauuuggagcuucuguggaguuacucucauuuuugccuucugacuucuucccgucuguccgggaccuacucgacaccgcuucagcccucuaccgagaugccuuagaaucacccgaacauugcacccccaaccauacugcucucaggcaagcuauucugugcuggggugaguuaaugacuuuggcuuccugggugggcaauaauuuagaggauccugcggcuagagaucuaguaguuaauuaugucaacacuaauaugggccuaaaaauuagacaauuacuaugguuucauauuuccugccuuacauuuggaagagaaacuguucuugaguauuuggugucuuuuggaguguggauucgcacuccaccugcuuauagaccaccaaaugccccuauccuaucaacacuuccggagacuacuguuguuagacaacgaggcagggccccuagaagaagaacucccucgccucgcagacgaagaucucaaucaccgcgucgcagaagaucucaaucuccagcuucccaauguuaguaucccuuggacucauaaggugggaaacuuuaccggucuuuacuccucuacuguaccuguuuucaauccugauugguuaacuccuucuuuuccugacauucaccuacaucaagauuugauacaaaaaugugagcaauuugugcgcccacucacuaaaaaugaagugagacgauugaaauuaauuaugccagcaagguuuuaucccaaagcuacuaaauacuucccuuuggauaaagguauuaaaccauauuauccagagaaugugguuaaucauuacuucaaaacuacacacuauuuacauacuuuguggaaggcaagaauucuauauaagagagaauccacacauagcgccucauuuugugggucaccauauuccugggaacaagaacuacagcaugggagcaccucucucaacggcgagaaggggcaugggacagaaucucucugugcccaauccucugggauucuuuccagaccaccaguuggauccacuauucagagcaaauuccagcagucccgauugggacuucaacacaaacaaggacaauuggccaauggcaaacaagguaggagugggaggcuuugguccaggguucacacccccacacgguggccuucugggguggagcccucaggcacagggcauucugacaaccucgccaccagauccaccucccgcuuccaccaaucggaggucaggaaggaaaccaaccccagucucuccaccucuaagggacacacauccacaggccaugcagug

SEQ ID NO: 525 - RNA, 3215 nt, Hepatitis B virus
gaacucaacacaguuccaccaagcacuguuggauccgagaguaaggggucuguaucuuccugcugguggcuccaguucagaaacacagaacccuguuccgacuauugccucucucacaucaucaaucuucucgaagacuggggacccugcuaugaacauggagaacaucacaucaggacuccuaggaccccuucucguguuacaggcgguguguuucuuguugacaaaaauccucacaauaccacagagucuagacucgugguggacuucucucaauuuucuagggguaccacccggguguccuggccaaaauucgcaguccccaaucuccaaucacuuaccaaccuccuguccuccaacuuguccuggcuaucguuggaugugucugcggcguuuuaucaucuuccucuucauccugcugcuaugccucaucuucuuguugguucuucuggacuaucaagguauguugcccguguguccucuacuuccaggaucuacaaccaccagcacgggucccugcaaaaccugcaccacucuugcucaaggaaccucuauguuucccuccugcugcuguaccaaaccuucggacggaaauugcaccuguauucccaucccaucaucuugggcuuucggaaaauaccuaugggagugggccucagcccguuucucuuggcucaguuuacuagugcaauuuguucaguggugcguagggcuuucccccacugucuggcuuuuaguuauauggaugauuugguauugggggccaaaucugugcagcaucuugagucccuuuauaccgcuguuaccaauuuuuuguuaucugugggcauccauuuaaacacagcuaaaacaaaauggugggguuauuccuuacacuuuauggguuauaucauugggaguugggggacauugccucaggaacauauugugcaaaaaaucaaagauugcuuucgcaaacuuccuguuaaucgacccauugauuggaaagucugucaacgaauugugggucuuuugggcuuugcagccccuuuuacucaaugugguuauccugcucucaugcccuuauaugccuguauuaccgcuaaacaggcuuuuguuuucucgccaacuuacaaggccuuucucuguaaacaauacaugaaccuuuaccccguugcucggcaacggccaggccuuugccaaguguuugcugacgcaacccccacuggcuggggcuuggcgauuggccaucagcgcaugcgcggaaccuuuguggcuccucugccgauccauacugcggaacuccuagcagcuuguuucgcucgcagccggucuggagcggacauuaucggcacugacaacuccguuguccugucucggaaguacaccuccuucccauggcugcuaggcugugcugccaacuggauccugcgcgggacguccuuuguuuacgucccgucggcgcugaauccugcggacgaccccucucguggucgccuggggcucugccgcccccuucuccgccuuccguuccggccgacgacgggucgcaccucucuuuacgcggacuccccgccugugccuucucaucugccggcccgugugcacuucgcuucaccucugcacgucgcauggagaccaccgugaacgccccucaaagcuugccaacaaccuuacauaagaggacucuuggacuuucaccccggucaacgaccuggauugaggaauacaucaaagacuguguguuuaaggacugggaggagucgggggaggaguugagguuaaaggucuuuguauuaggaggcuguaggcauaaauuggucuguucaccagcaccaugcaacuuuuucaccucugccuaaucaucuuuuguucaugucccacuguucaagccuccaagcugugccuuggguggcuuuggggcauggacauugacccuuauaaagaauuuggagcuucuguggaguuacucucauuuuugccuucugacuucuucccgucuguccgggaccuacucgacaccgcuucagcccucuaccgagaugccuuagaaucucccgaacauugcacccccaaccauacugcucucaggcaagcuauucugugcuggggugaguuaaugacuuuggcuuccugggugggcaauaauuuagaggauccugcggcuagagaucuaguaguuaauuaugucaacacuaauaugggccuaaaaauuagacaauuacuaugguuucauauuuccugccuuacauuuggaagagauacuguucuugaguauuuggugucuuuuggaguguggauucgcacuccaccugcuuauagaccaccaaaugccccuauccuaucaacacuuccggagacuacuguuguuagacaacgaggcagggccccuagaagaagaacucccucgccucgcagacgaagaucucaaucaccgcgucgccgaagaucucaaucuccagcuucccaauguuaguaucccuuggacucauaaggugggaaacuuuaccggucuuuacuccucuacuguaccuguuuucaauccugauugguuaacuccuucuuuuccugacauucaccuacaucaagauuugauacaaaaaugugaacaauuuguaggcccacucacuaaaaaugaagugagacgauugaaauuaauuaugccagcaagauuuuaucccaaaguuacuaaauacuucccuuuggauaaagguauuaaaccauauuauccagagcaugugguuaaucauuacuucaaaacuagacacuauuuacauacuuuguggaaggcaggaauucuauauaagagagaauccacacauagcgccucauuuugugggucaccauauuccugggaacaagagcuacagcaugggagcaccucucucaacggcgagaaggggcaugggacagaaucuuucugugcccaauccucugggauucuuuccagaccaccaguuggauccacuauucagagcaaauuccagcagucccgauugggacuucaacacaaacaaggacaauuggccaauggcaaacaagguaggagugggaggcuuugguccaggguucacacccccacacgguggccuucugggguggagcccucaggcacagggcauucugacaaccucgccacccgauccaccucccgcuuccaccaaucggaggucaggaaggaaaccaaccccagucucuccaccucuaagggacacacauccacaggccaugcagug

SEQ ID NO: 526 - RNA, 3215 nt, Hepatitis B virus
gaacucaacacaguuccaccaagcacuguuggauccgagaguaaggggucuguauuuuccugcugguggcuccaguucagaaacacagaacccugcuccgacuauugccucucucacaucaucaaucuucucgaagacuggggacccugcuaugaacauggagaacaucacaucaggacuccuaagaccccuucucguguuacaggcgguguguuucuuguugacaaaaauccucacaauaccacagagucuagacucgugguggacuucucucaauuuucuagggguaccacccggguguccuggccaaaauucgcaguccccaaucuccaaucacuuaccaaccuccuguccuccaacuuguccuggcuaucguuggaugugucugcggcguuuuaucaucuuccucuucauccugcugcuaugccucaucuucuuguugguucuucuggacuaucaagguauguugcccguguguccucuacuuccaggaucuacaaccaccagcacgggacccugcaaaaccugcaccacucuugcucaaggaaccucuauguuucccucuugcugcuguaccaaaccuucggacggaaauugcaccuguauucccaucccaucaucuugggcuuucggaaaauaccuaugggagugggccucagcccguuucucuuggcucaguuuacuagugcaauuuguucaguggugcguagggcuuucccccacugucuggcuuuuaguuauauggaugauuugguauugggggccaaaucugugcagcaucuugagucccuuuauaccgcuguuaccaauuuuuuguuaucugugggcauccauuugaacacagcuaaaacaaaauggugggguuauuccuuacacuuuauggguuauauaauugggaguugggggaccuugccucaggaacauauugugcauaaaaucaaagauugcuuucgcaaacuucccgugaauagacccauugauuggaagguuugucaacgcauugugggucuuuugggcuuugcagccccuuuuacucaaugugguuauccugcucucaugcccuuguaugccuguauuaccgcuaagcaggcuuuuguuuucucgccaacuuacaaggccuuucucuguaaacaauacaugaaccuuuaccccguugcucggcaacggccaggccuuugccaaguguuugcugacgcaacccccacuggcuggggcuuggcgauuggccaucagcgcaugcgcggaaccuuuguggcuccucugccgauccauacugcggaacuccuagcagcuuguuucgcucgcagcaggucuggagcggacauuaucggcacugacaacucuguuguccuuucucggaaguacaccuccuucccauggcugcucggcugugcugccaacuggauccugcgcgggacguccuuugucuacgucccgucggcgcugaauccugcggacgaccccucucguggucgcuuggggcucugccgcccucuucuccgccugccguuccggccgacgacgggucgcaccucucuuuacgcggacuccccgccugugccuucucaucugccggcccgugugcacuucgcuucaccucugcacgucgcauggagaccaccgugaacgccccuuggaacuugccaacaaccuugcauaagaggacucuuggucuuucgccccggucaacgaccuggauugaggaauacaucaaagacuguguauuuaaggacugggaggagucgggggaggaguugagguuaaaggucuuuguauuaggaggcuguaggcauaaauuggucuguucaccagcaccaugcaacuuuuucaccucugccuaaucaucuuuuguucaugucccacuguucaagccuccaagcugugccuuggguggcuuuggggcauggacauugacccuuauaaagaauuuggagcuucuguggaguuacucucauuuuugccuucugacuucuucccgucuguccgggaccugcucgacaccgcuucagcccucuaccgagaugccuuagaaucacccgaacauugcacccccaaccacacugcucucaggcaagcuauuuugugcuggggugaguugaugaccuuggcuuccugggugggcaauaauuuagaggauccugcagcaagagaucuaguaguuaauuaugucaauacuaacaugggccuaaaaauuagacaauuauuaugguuucacauuuccugccuuacauuuggaagagaaacugugcuugaguauuuggugucuuuuggaguguggauucgcacuccaccugcuuauagaccaccaaaugccccuauccuaucaacacuuccggagacuacuguuguuagacaacgaggcagggccccuagaagaagaacucccucgccucgcagacgaagaucucaaucaccgcgucgcagaagaucucaaucuccagcuucccaauguuaguauuccuuggacucauaaggugggaaacuuuaccggucuuuacuccucuacuauaccuguuuuuaauccugacuggcuaacucccucuuuuccugacauucacuugcaucaagaucugauacaaaaaugugaacaauuuguaggcccacucacuacaaaugaaaggagacgauugaaacuaauuaugccagcuagguuuuaucccaaaguuacuaaauacuucccuuuggauaaagguauuaagccuuacuauccagagaaugugguuaaucauuacuucaaaacuagacauuauuuacauacuuuguggaaggcaggaauucuauauaagagagaauccacacauagcgccucauuuugugggucaccauauuccugggaacaagagcuacagcaugggagcaccucucucaacggcgagaaggggcaugggacagaaccuuucugugcccaauccucugggauucuuuccagaccaccaguuggauccacuauucagagcaaauuccagcagucccgauugggacuucaacacaaacaaggacaauuggccaauggcaaacaagguaggagugggaggcuucgguccaggguucacacccccacacgguggccuucugggguggagcccucaggcacagggcauucugacaaccucgccaccagauccaccuccugcuuccaccaaucggaggucaggaagaaagccaaccccagucucuccaccucuaagggacacacauccacaggccaugcagug

What we claim is:

1. A double-stranded short interfering nucleic acid (siNA) molecule that inhibits expression of the Hepatitis B virus (HBV), comprising a sense strand comprising the nucleotide sequence 5'-uuCCgcagUauGGaUCGGCUsU-3' (SEQ ID NO:376) and an antisense strand comprising the nucleotide sequence 5'-B GccGAuccAuAcuGcGGAAUsU B-3' (SEQ ID NO:224),
wherein B is an inverted a basic moiety; the bolded nucleotides comprise 2'-O-methyl modifications, the lower case nucleotides comprise 2'-fluoro modifications, and the s is a phosphorothioate linkage.

2. A composition comprising the double-stranded short interfering nucleic acid (siNA) according to claim 1 and a pharmaceutically acceptable carrier or diluent.

3. A composition comprising:
(a) the double-stranded short interfering nucleic acid (siNA) of claim 1;
(b) a cationic lipid;
(c) cholesterol;
(d) DSPC; and
(e) PEG-DMG.

4. A composition comprising:
(a) the double-stranded short interfering nucleic acid (siNA) of claim 1;
(b) (13Z,16Z)-N,N-dimethyl-3-nonyldocosa-13,16-dien-1-amine;
(c) cholesterol;
(d) DSPC; and
(e) PEG-DMG.

5. The composition according to claim 4, wherein the (13Z, 16Z)-N,N-dimethyl-3-nonyldocosa-13,16-dien-1-amine, cholesterol, DSPC, and PEG-DMG have a molar ratio of 50:30:10:2 respectively.

6. A composition comprising the composition according to claim 5 and a pharmaceutically acceptable carrier or diluent.

7. A method of treating a human subject suffering from a condition which is mediated by the action, or by loss of action, of Hepatitis B Virus (HBV), which comprises administering to said subject an effective amount of the double-stranded short interfering nucleic acid (siNA) molecule of claim 1, thereby treating the human subject suffering from a condition which is mediated by the action, or by loss of action, of HBV.

8. The method according to claim 7, wherein the condition is HBV infection.

9. The method according to claim 7, wherein the condition is hepatocellular carcinoma.

10. A kit comprising the double-stranded short interfering nucleic acid (siNA) according to claim 1.

11. The method of claim 7, wherein the condition is liver disease.

12. The method of claim 11, wherein the liver disease is cirrhosis.

13. A method of treating a human subject suffering from Hepatitis B Virus (HBV) infection to reduce the progression of HBV to hepatocellular carcinoma, comprising administering to said subject an effective amount of the double-stranded short interfering nucleic acid (siNA) molecule of claim 1, thereby treating the human subject suffering from Hepatitis B Virus (HBV) infection to reduce the progression of HBV to hepatocellular carcinoma.

14. A method of treating a human subject suffering from hepatocellular carcinoma, comprising administering to said subject an effective amount of the double-stranded short interfering nucleic acid (siNA) molecule of claim 1 and an anti-cancer agent, thereby treating the human subject suffering from hepatocellular carcinoma.

15. The method of claim 14, wherein the chemotherapeutic agent is sorafenib.

* * * * *

UNITED STATES PATENT AND TRADEMARK OFFICE
CERTIFICATE OF CORRECTION

PATENT NO. : 9,029,341 B2  
APPLICATION NO. : 13/817152  
DATED : May 12, 2015  
INVENTOR(S) : Steven Bartz et al.

Page 1 of 1

It is certified that error appears in the above-identified patent and that said Letters Patent is hereby corrected as shown below:

Claims

At column number 163, claim number 1, line number 49, delete "5' – uuCCgcagUauGGaUCGGCUsU - 3'" and replace it with --5'– uuCCgcagUauGGaUCGGCUsU - 3'--

At column number 163, claim number 1, line number 51, delete "5' – B GccGAuccAuAcuGcGGAAUsU B - 3'" and replace it with --5' – B GccGAuccAuAcuGcGGAAUsU B - 3'--

Signed and Sealed this  
First Day of March, 2016

Michelle K. Lee  
*Director of the United States Patent and Trademark Office*